United States Patent 11,098,302 (IDENTIFICATION OF POLYNUCLEOTIDES ASSOCIATED WITH A SAMPLE) - sequence listing, part 127

SEQ ID NO: 440887 - DNA, 640 bp, Homo sapiens
  misc_feature: GZ8MTXP02GBI42.10.88.H11.1.454.CMB.2.raw
  modified_base (208)..(208): a, c, t, g, unknown or other
  modified_base (287)..(287): a, c, t, g, unknown or other
  modified_base (367)..(367): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagngcccgtggggcctcagtgaagatctcctgcgaggtcttcgtggttaccacctttaacacctatggcatctccgtgggtncgacacggcccctggacaaggctgaggtggggtggggtggtcaggcgtcttaccgaagttggctaacgactaaaatttgngacaacagtaacgttccagggacaaggacgtaccaaccagtacgaacccacagaccacactccaacgacgacacacgacctacagtacggaactaggaggacgccgtaggacgtaagtccgtaggaaccggaacgaccggtaccggttaactttaacgtttcgtacggccggacggaaacggtaaaggtaaaccggttaaaaaggtcggtaaccgggtaagggttacgggttaccggggggactaacgtacgttacggaaccggtaaccgggg

SEQ ID NO: 440888 - DNA, 531 bp, Homo sapiens
  misc_feature: GZ8MTXP02IHCLA.10.88.H11.1.454.CMB.2.raw
  modified_base (347)..(347): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtgggtggggtggtcagcgcttaccagttgctacacaaattntgcacagtaagttccagggcagagtcaccatcgaccacagacacataccacgagcacagcctacagtaggaaactggagggacgcccgtgagaatctaggaacgacgacggtaccgtatactttctgcgcggaagacgacgtaaaagtgaggtgacgttacgggggacacgagtcgactaccgg

SEQ ID NO: 440889 - DNA, 701 bp, Homo sapiens
  misc_feature: GZ8MTXP02IY4RO.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtagaagacgcccgtgggcctgagtgaagatctcctgcgaggtcttcgtgtactaccttaacactagtgcatcgtcgtggtcgcgtacgcggccctggacaaggtcttggaggtggggtggggtcggtcgaggtccgtacgttaaccgaaggtttcggactaaactaactaaactttagcgactacgaagtaacgttccaggacaggactaccgacagtcgaaccaacgaacgtacactacaccgacgacgacaacgacacctacgaacgtacggaaacgtaggaggtaacgtccgtaggaactacgtccgtaacggaaccgtaaaccggtaccgggttaccttaacgttacgtttaacggcggtaaccgggtaaacggaaaacgggaaacggttaaaaccggggtaaaaaggtcgggtaaacgggtttaacgggggttaccgggggttaaccgggggaaactaccggtaacgttacgggaaacccggtaaccggggg

SEQ ID NO: 440890 - DNA, 534 bp, Homo sapiens
  misc_feature: GZ8MTXP02GPQRP.10.88.H11.1.454.CMB.2.raw
  modified_base (281)..(281): a, c, t, g, unknown or other
  modified_base (352)..(352): a, c, t, g, unknown or other
  modified_base (477)..(477): a, c, t, g, unknown or other
  modified_base (496)..(496): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacaggcccctggacaaggcttggaggtggggtgggtggtcagcgcttaccaagttgctacactaaattngacacagtaagttccaggacagagtcaccatcgaccacagacacatccacgagacacacgacctacataggaactaggaggagccgtagagagtcgtgacgacgacggaccgtattacttctcgngacgagacgaacgtaaagngtagtggtacgtacggggacacgagtacgacgtaccgg

SEQ ID NO: 440891 - DNA, 616 bp, Homo sapiens
  misc_feature: GZ8MTXP02GW4WM.10.88.H11.1.454.CMB.2.raw
  modified_base (283)..(283): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttaccacctttaacacctatggcatctcctgggtncgacacggcccctggacaaggacttggaggtggggtggggtggtcaggcgcttacgaggttgctacacaattatgcacagacgttccaggtacagacgtacaccatcgacccacagacacactacccaacgacgaccaacacgaccctaaacgacgtagggaaacctaggaacggtacgcccgtaggaacgtacgtacgtacggaacgacgtacccgggtacccgttaattacgttttcgacgacggacggaaacggagtaaaccggtaaaacggtggtaaccggtaagggttaacggttaccgggggacacgtacgtacgaccggtaccggg

SEQ ID NO: 440892 - DNA, 574 bp, Homo sapiens
  misc_feature: GZ8MTXP02IE60G.10.88.H11.1.454.CMB.2.raw
  modified_base (281)..(281): a, c, t, g, unknown or other
  modified_base (293)..(293): a, c, t, g, unknown or other
  modified_base (353)..(353): a, c, t, g, unknown or other
  modified_base (394)..(394): a, c, t, g, unknown or other
  modified_base (499)..(499): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggcttctggttacacctttaacactatgcatctcgtgggtncgacaggccccnggacaaggcttggagtggggtggggtggtcagcgtcttacaaggtgctacactaaattangcaacgagtaagttccagggacagacgtacaccatcgacanagacacactcacgagacacacgacctaacagtacggaactaggaaggtacgaccgtaggaacgtactacgtagaacggaacgacgggtaccgtaattactttcgnggcgacgaaaggacgtaacgtaaaaggtgaacggtaaggtacggttacgggggacacgtacgtacgacgaccggg

SEQ ID NO: 440893 - DNA, 639 bp, Homo sapiens
  misc_feature: GZ8MTXP02I8PDZ.10.88.H11.1.454.CMB.2.raw
  modified_base (284)..(284): a, c, t, g, unknown or other
  modified_base (362)..(362): a, c, t, g, unknown or other
  modified_base (410)..(410): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcagtgaagatctctgcgaggtcttctggttacacctttaacacctatggcatctcctgggtncgacaggcccctggacaggacttgaggtgggtggggtggtcaggcgcgttaccgaagttggactaacgactaaacttntacgacaacaagtaacgttccaggggtacaggtacgtccaacccgtanacggacccacagacacactaccacgagccaacgacgaccacgagtaggaaactaggaacggacgtaccgaggagatcgacggacgaacgtaccggaccgttaatactttcgtaggtacggaccggtaaaggtaacggtaaaccggttaaaaggtacgtaacggttaacggggttaacggggtttaaccggggggactaacggtacggttaacggaccgtaacccggggg

SEQ ID NO: 440894 - DNA, 611 bp, Homo sapiens
  misc_feature: GZ8MTXP02GPE96.10.88.H11.1.454.CMB.2.raw
  modified_base (285)..(285): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctctgcgaggcttctggttacacctttaacacctatggcatctccgtggtgcgacncggcccctaggacaaggcttggagtggggtggttggtagcgtacttacgaagttggactaacataaattactgacaacagtaacgttccgaagggtacagtaagtccaacctatacgaacccaacgaacgaaccaacaactaccgaacgacgacaacacgacctaacgagtaggaaaccgtagaacgggacgtaccgagacgagttccgaggaccggacgaacggtccgttatacgttctacggcgacggaacgaaggaaacgtaaaacggtagtacggtaggtaacggttaccgggggaacacgtagacgacgtacggtacgggg

SEQ ID NO: 440895 - DNA, 696 bp, Homo sapiens
  misc_feature: GZ8MTXP02G6F5T.10.88.H11.1.454.CMB.2.raw
  modified_base (288)..(288): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttcgtggttaccacctttaacacctatggcatctccgtgggtcncgacacggcccctggacaaggcttggaggtggggtggggtggtcaggccgtcgttaccgaaggttcggactaacgaactaaattatcgacaacgtaggtaaacgttccgagggtacaggtacgtaccaacctagtacgaacccaacaacgaaccaacaactacccaacgaacgaccaacgacgaccctaacgacgtacggaaacgtaggacgggacgaccgtaggaacgtacgttaccgtacggaaccgaaccgaccgggtacccgttaattaccgtttacgcggtacggaccggtaaaggtaaacggtaaacggttaaaaacggttacggttaacgggttaacgggggttaccgggttaacccggggggaacctaacggtacgttaccggaaccgtaaccccggggg

SEQ ID NO: 440896 - DNA, 538 bp, Homo sapiens
  misc_feature: GZ8MTXP02IWLBZ.10.88.H11.1.454.CMB.2.raw
  modified_base (207)..(207): a, c, t, g, unknown or other
  modified_base (285)..(285): a, c, t, g, unknown or other
  modified_base (354)..(354): a, c, t, g, unknown or other
  modified_base (407)..(407): a, c, t, g, unknown or other
  modified_base (473)..(473): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngccctggggcctcagtgaagatctcctgcgaggtcttcgtggttacctacctttaacacctatggcatctcgtgggtncgacaggcccctggacaaggcttggaggtggggtgggtggtcagcgtcttacagttgctacactaatangacacagaacgttcaggacagagtaccacatacgaccacagacacatccaganaccacacgactacagtaggaactggaggagcctagagatcgtagacgacgacggtactatacttcngcgacgagacgaacgtaaagtgacggttggtacggttacgggggacagacgtacgacgtaccggg

SEQ ID NO: 440897 - DNA, 604 bp, Homo sapiens
  misc_feature: GZ8MTXP02IHUON.10.88.H11.1.454.CMB.2.raw
  modified_base (291)..(291): a, c, t, g, unknown or other
  modified_base (359)..(359): a, c, t, g, unknown or other
  modified_base (369)..(369): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtcgtggggctggaggtgaagcgcccgtggggcctcgagtgaagatctcctgcgaggcttcgtggttaactaccctttaacacctagtggcatctccgtgggtcncgacacggcccctggacgaaggcttggaggtggggtgggtggtcagcgtacttaccgaggttgactanaacaattagngacacgagtacgttccagggaccagacgtccaccgatcgaacccacagacctaacactaccgaacgacgacaacacgacctacacgtacggaactaggacggacgtccgtagagactacgtagacgaccgacggtaccgtagttactttcgagtcggacgtaagaacggtaacgtaaaacgtggtaccggttaaggtacggtacgggggacacggacgtacggacgtaaccgggg

SEQ ID NO: 440898 - DNA, 582 bp, Homo sapiens
  misc_feature: GZ8MTXP02GCV34.10.88.H11.1.454.CMB.2.raw
  modified_base (285)..(285): a, c, t, g, unknown or other
  modified_base (365)..(365): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggcttctggttacacctttaacacctatggcatctccgtgggtcncgacacggcccctggacaaggcttggaggtggggtggggtggtcagcgtcttacgaagttcggactaacgactaaatttngacaacagaacgttccagggacagagtccaccatcgaaccacacgacacactaccaacgacgacacacgacctaacagtacggaaactggaacggagccgtagacgaactcgagacgacgacggtaccgtattacttcgtgacgacgagaacgaacgtaaaagcgtaacggtaaggtacggttaccgggggactacgacgtacggactaacccgggg

SEQ ID NO: 440899 - DNA, 624 bp, Homo sapiens
  misc_feature: GZ8MTXP02HHPOJ.10.88.H11.1.454.CMB.2.raw
  modified_base (556)..(556): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcagtgaagatctcctgcgaggcttctggttacacctttaacacctatggcatctccgtgggtgccgacacggcccctaggaacaaggacttggaggtggggtgggggtggtcaggccgtacgttaccgaaaggtttggactaacaacaaaatttacaggaccaacaaaggtaacgttacccgaggggtaccaaggtaacgtccgaaccctagtacgaaacccaacaacgaacaacactacccaacgacgacaacgacgaccctacaacgtaggaaccgtaggaaggacgaccgtagagactacgagaacgacgaccggacgtacttatttcgngcgacgagaacgaacgtaaagtagtacggtaaggtacggtaccgggggacacgacgtacgacgaccgg

SEQ ID NO: 440900 - DNA, 619 bp, Homo sapiens
  misc_feature: GZ8MTXP02FZ47D.10.88.H11.1.454.CMB.2.raw
  modified_base (285)..(285): a, c, t, g, unknown or other
  modified_base (357)..(357): a, c, t, g, unknown or other
  modified_base (361)..(361): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggcttctggttacacctttaacacctatggcatctccgtgggtcncgacacggcccctaggacaaggtcttggaggtggggtggggtggtcagcgctacgagttgctacactaattngcanagtaacgttcaggacagatccacatcgaccacagacacactaccacgacgacaacacgacctaacgagtaggaaaccgtaggaacggacgccgtaggagactacgtacggaccgaaccggaccggtaccgttaattactttcgtaggaccggacggaaacggaaacggtaaacggtaaaaggtacggtaacgggttaacggggttaacgggttacccggggggaacgaacgtacggtaacggtacccggtaaccgggg

SEQ ID NO: 440901 - DNA, 647 bp, Homo sapiens
  misc_feature: GZ8MTXP02GI618.10.88.H11.1.454.CMB.2.raw
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttcgtggttaccacctttaacacctatggcatctccgtgggtgcgacacggcccctggacaaggtcttggaggtggggtggggtggtacaggccgtcttaaccgaaggttcggactaacaactaaaattnagacacgagtaacgttccgaggacagacgtaccaccatcgaccacagacacactaccaacgacgaccaacgacgaccctaactaagtaacggtaaacgtagggaacggacgacccgtagaacgtactacgtacggaaccggaacccgaaccggtaccgttaagttacgtttacgtcggacggacggaaaggtaacggaaacgtaaaacggtaggtacggttaagggtaacgggttaccgggggaactaacggtacgtacgaccgtaacccgggg

SEQ ID NO: 440902 - DNA, 675 bp, Homo sapiens
  misc_feature: GZ8MTXP02HMIZE.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctctgcgaggcttctggttacaccttaacacctatcggcatctccgtgggtcgcgacgacggcccctaggacaaggtcttggaggtggggtaggggtggtacagcgtacttaacgtaaggttggactaacaacgtaaattagtgaccaactaggtaacgttaccgaggggaaacaaggacgtaccaaccgtaatacgaaacccaacgaacgaccaacgaactacccgaacgacgacaacgacgaccctaacagtacggaaaccgttagggaacggtacgccgtaggagtacgtacgtaggaaccgaacggaccggtaccgttaattacttttacgcggacggacggaacggtaaacggtaaaccggtaaaaggtcggtaacgggttaagggttaacgggttaccgggggaactaacggtacgtacggtaaccggtaacccgggg

SEQ ID NO: 440903 - DNA, 696 bp, Homo sapiens
  misc_feature: GZ8MTXP02H2TI7.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtcgcccactcccaggttcagctggtgcagtcgtgggggctggagggtgaagacgcccgtggggcctcagtgaagatctcctgcgaggcttcgtggttacacctttaacacctatggcatctccgtgggtgcgacgacggcccctaggacaaggtcgttggaggtgggggttgggggtcgggttcgaggtccgtccgtttaaccgtaagggtttacgggtacctaaaccgaactaaaatttacgtacggacctaaaccgtaaaggttaaacgtttacccgaagggggaccaaaggtaaccggtaccaaaccgtagacgaaacccaacaaacgaaccaacaactacccgaacgacgacacacgacctacagtacggaactgaacggagccgtagagattcgacgaacggacgtacggtacgtatttacgttcgtacggcggaacgaggaaacggtaaacggtaaaagtacgggtaacggttcggggttaacgggttaccggggggaactaacggacggttacggaaccgtacccggggg

SEQ ID NO: 440904 - DNA, 651 bp, Homo sapiens
  misc_feature: GZ8MTXP02F80DL.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccctggggcctcagtgaagatctcctgcgaggcttctggttacacctttaacacctatggcatctcctgggtgcgacaggcccctaggacaaggacttgagtggggtggggtggtcagcgcttaccgaagttgctacacaaattatgacacagaagttccaggacaggagtccaaccgatagaccacagacacataccacgagacacaacgcctacatacggaaacgtaggacgggagcctaggaagtacgtccgtagaccgaaacgaccgggtacccgttaagttaacgttttccgtaggtaccggaccgggaaaggtaaacggtaaaaccgggttaaaaacggttacgggtaaccggggttaagggggtttaaaccggggtttacccggggggggtaaaccaaacccggtaaggttacggaaacccggtaaccccggggg

SEQ ID NO: 440905 - DNA, 623 bp, Homo sapiens
  misc_feature: GZ8MTXP02JVE7L.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttcgtggttacacctttaacacctatggcatctccgtgggtgcgacgacggcccctggacgaaggcttggaggtggggtggggtggtcgaggcgtcttaccgaggttcggactaacgaactaaattcgtagacaacgaggtaacgttccgagggtaccaggtacgtaccaaccgtaagtacgaaacccaacaacgaaccaaccgactacccgaacgacgaccaacgacgacctacagtaacggactaggacggacgcgtacggagtactcgtacgacgaccgacgtacgtattacttcgtacgacgacgaagaacgtaaacgtaaaggtacgtacggtggtacgggttacgggggactacgacgtacggaccgtacggg

SEQ ID NO: 440906 - DNA, 674 bp, Homo sapiens
  misc_feature: GZ8MTXP02IG98E.10.88.H11.1.454.CMB.2.raw
  modified_base (262)..(262): a, c, t, g, unknown or other
  modified_base (279)..(279): a, c, t, g, unknown or other
  modified_base (284)..(284): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagcgcccgtggggcctcagtgaagatctctgcgaggtcttcgtgtactaccttaacnctatgcatctcgtggtncgacncggccctggacaggacttggaggtggggtggggtggtcgaggtcgtcttaccgaggttcggactaacgactaaaattgtagacaacgaagtaacggttccgagggtacaaggacggtaccaaccagtacgaacccacacgaaccacactcccaacgacgaccaacacggacctaacgataacgggaacgtaggaacgggtagtacccgtaggaacgtacttaccgaacggaaccggaaccgtaaccggggtaccgtaaatttacgtttccgtacgggtaccggaccgtaaagggaaacggtaaaacggttaaaacgggttacggtaacgggttaacggggttaacgggtaccgggggacaaacggtagttaccggaaccgaacccggggg

SEQ ID NO: 440907 - DNA, 664 bp, Homo sapiens
  misc_feature: GZ8MTXP02F2RBY.10.88.H11.1.454.CMB.2.raw
  modified_base (283)..(283): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttaccacctttaacacctatggcatctccgtgggtncgacgacggcccctaggacaaggcttggaggtggggtggggtggtcaggcgtcttaccgaagttcggactacactaaattatgacaacgagtaacgttcaggacagagtccacatcgaccacagacacactcccagacgcaacgacgaccctaacgatacgggaaaccgtaggaacggacgacccgtaggaacggtactaccgtacggaaccggtaaccgtaccgggtaccgttagtttaacctttccggtacggtaccgggaccggtaaaggtaaacggtaaaaccggttaaaaacgggtacggttaaccgggtaaggggttaaccgggttacccggggggaaactaaccgtaggttaccggaaccggtaaccccggggg

SEQ ID NO: 440908 - DNA, 600 bp, Homo sapiens
  misc_feature: GZ8MTXP02JZ95H.10.88.H11.1.454.CMB.2.raw
  modified_base (283)..(283): a, c, t, g, unknown or other
  modified_base (362)..(362): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctccgtgggtncgacacggcccctggacaaggcttgaggtggggtggggtggtcaggcgacttaccgaagttggactaacgactaaattntgcacagtaacgttccaggtacagacgtcaccatacgaccacacgacacactaccacgacgacacacgcctacgatacggaacgtggacggacgccgtaggagacgtcgtaggaccgaacgacggtacccgttaatacgttttacgagccggacgaaggaacggtaaacgtaaaaggtacggtaacggttaagggttaacggtaccgggggactacgacgtacggaccgtacccgggg

SEQ ID NO: 440909 - DNA, 634 bp, Homo sapiens
  misc_feature: GZ8MTXP02JUBJ8.10.88.H11.1.454.CMB.2.raw
  modified_base (376)..(376): a, c, t, g, unknown or other
  modified_base (442)..(442): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctcctgcgaggcttcgtggttacacctttaacacctatggcatcctccgtgggtgcgacacggcccctaggacgaaggacttggagggttggggtggggtggtcgagcgtacttacgaagttcggactacagtaaatgtgacanagtaacgttccagcaagcgtacaaccatacgaaccacacgacacacaccacgagacacacgaccanacgtaggaactggaacgggacgaccgtagggaactacgttacgacggaacggaccgtaaccgggtaccgttaagtttacgtttcgcggaccgggacggaaaggaaacggttaaaacggtaaaaggtacgggtaacggtaacggggttacgggttacccgggggaacaccgtaggaccggtacgaacccgggg

SEQ ID NO: 440910 - DNA, 648 bp, Homo sapiens
  misc_feature: GZ8MTXP02GO65E.10.88.H11.1.454.CMB.2.raw
  modified_base (288)..(288): a, c, t, g, unknown or other
  modified_base (377)..(377): a, c, t, g, unknown or other
  modified_base (416)..(416): a, c, t, g, unknown or other
  modified_base (622)..(622): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggtcttcgtggttaccacctttaacacctatggcatctccgtgggtnacgacacggcccctggacaaggtcttggaggtggggtggggtgggtcaggccgtacgttaccgaaaggttggactaaacactaaatttntagcaacagtaacgttccagggacaggactaccgaaccntacgaaccaacgagaaccaacaagtacccaacgaacgaccaaccgacgaccctaacgaagtacggaaacctagggaaggtacgcccgtaaggaagtaactacgtaggaaccgaacggtacggtacccgttaaattcgtttacgacggtcgaacggagtaacgtaaacgtaaaagtggacggttaaggtacgggttacccggggganaccgtaagtacggaaccgtaccgggg

SEQ ID NO: 440911 - DNA, 895 bp, Homo sapiens
  misc_feature: GZ8MTXP02H3X54.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattcctttttcttggtggcagcagcaacaggtcgcccactcccaggttcagctggtgcagtcgtgggctggaggtgaagacgcccgtggggcctgagtagaagatcctcgtgcgaggtctttcgtggttacctaacctttaacacctagtcggcattccgtccgtggggtcgaccggaacgaccgggtacccccgtagggaaaccgtaaagggttaccgtttaggggtaggggttcgggggggtggggggttcggggtaccgaacgggtccggttacccgtttaaacccggaagggtttaccggggtaaccttaaaccgaaaacgttaaaagtttacgtacggaacgtaaacggtaaaggttaaaccggtttcccgaaggggtaaaccaaggtaaccgttaacccgaaaccctaagttacccgaaaccccaaaccgaaacgaacccaacccaacgtaaccccgaaaccggaccgaaccaaacccgaaccgtaaccccttaacgaaacggtacggtaaaacccgtgggaaacgggtaccgtacccgtaaggaacgtaacgttaccgtaacgggaaacccggtaaaccggtaacccgggtaacccgtttaaagtttaacgttttccgaacgggtaccggtaacggaaacgggtaaacggtaaaaaccggttaaaaacggttcgggtaaccggggtttaacgggttaaaccgggggtacccgggggtaaacctacggtaacggtaccgggaaacccggtaacccgggg

SEQ ID NO: 440912 - DNA, 696 bp, Homo sapiens
  misc_feature: GZ8MTXP02HANHY.10.88.H11.1.454.CMB.2.raw
  modified_base (247)..(247): a, c, t, g, unknown or other
  modified_base (283)..(283): a, c, t, g, unknown or other
  modified_base (288)..(288): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggcttntggttacacctttaacacctatgcatctcgtgggtncgacnggcccctaggacaaggtacttggaggtggggtggggtgggtcaggtcgtacgttaaccgtaaggttcggacctaacgaactaaaatttgacgacaacgtaagtaacgttcccgaggggaacaaggtaccgtaccaaacctacgtacgaaacccaacaacgaacccaacacgtacccaacgacgaccaaccgaacgtaccctaacgtaacgtacggtaaacgtacggaacgggacgaccgtaggaacgtactacgtacggaaccgaccgtaaccggtaccgttaagttacctttcgtacggaccggacggaaacggtaacggtaaaccggttaaaaggtaccggtaagggttaacggggtacgggttaaccgggggaactacgacggttacggaccggtaacccggggg

SEQ ID NO: 440913 - DNA, 662 bp, Homo sapiens
  misc_feature: GZ8MTXP02I9J75.10.88.H11.1.454.CMB.2.raw
  modified_base (283)..(283): a, c, t, g, unknown or other
  modified_base (309)..(309): a, c, t, g, unknown or other
  modified_base (354)..(354): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctccgtgggtncgacacggcccctggaacaggcttgnggtggggtggggtggtcagcgtctacaagtggctacactaaattntgcacagaacgttccagggacaggatccaaccagtcgaaccaacagaaccacactcccaacgacgaccaacacgacctacaacgtacgggaaactaggaacggacgtacccgtaggtaacgtacgtaccgtacggaaccgtaacccgaccgggttaacccgttagtttaaccgtttacgttacggtacggaccggtaaaggtaaacggtaaaaccggttaaaaaggtcgggttaaacgggttaacggggtttaacgggtaacccggggggtaacaaccggtacgttacggaacccgttaacccggggg

SEQ ID NO: 440914 - DNA, 598 bp, Homo sapiens
  misc_feature: GZ8MTXP02JSDIK.10.88.H11.1.454.CMB.2.raw
  modified_base (511)..(511): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagccctggggcctcagtgaagatctcctgcgaggcttctggttacacctttaacacctatggcatctcctgggtgcgacacggcccctaggacaaggcttggaggtggggtggggtggtcgagcgtcttaccgagttcggctacaataaattatgacacagaacgttccaggtacagacgtcactaagtcgaaccacacgaaccacaactaccaacgacgaccaacaacgaccacacgtaggaactaggacggaagccgtagaagactcgtacggacgacgacggaccgttattactttacgngcgacggaacggtaacgaaccggtaaaagtcggaaggtaagggttacggttaccggggggaacacgacttacggacgtaacccgggg

SEQ ID NO: 440915 - DNA, 610 bp, Homo sapiens
  misc_feature: GZ8MTXP02HGTV2.10.88.H11.1.454.CMB.2.raw
  modified_base (286)..(286): a, c, t, g, unknown or other
  modified_base (291)..(291): a, c, t, g, unknown or other
  modified_base (377)..(377): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctgaggtgaagagcccgtggggcctcagtgaagatctcctgcgaggtcttctggttacacctttaacactatggcatctccgtgggtcncgacncggcccctaggacaaggctttggaggtggggtggggtggtcaggccgtacgttaccgaaaggttcggactaacgacaaaagtttangacaactaggtaaacgttcccgagggtaccaaggtatacccgaaccatcgaaacccaacagaacacactaccaacgagaccaacaacgacctacagtaggaacgtaggaacggagcctagagactactacggacgaacgacggaccgttaatactttcgtagcgacgaaggacgtaacgtaaaacggtagacggtcggttacggtaccgggggacacgtactacgacgaccgg

SEQ ID NO: 440916 - DNA, 643 bp, Homo sapiens
  misc_feature: GZ8MTXP02G7CHG.10.88.H11.1.454.CMB.2.raw
  modified_base (222)..(222): a, c, t, g, unknown or other
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctnagtgaagatctcctgcgaggcttctggttacacctttaacacctatgcatctccgtgggtcgcgacgacggcccctaggaacaaggtacttggaggtggggtggggtggtcaggcgtacttacgaaaggttcggctaaacgactaaaattntgacagtaacgaacgttccgagggacaaggtacgtacaacccagtacgaaaccacagacacacgtaccaacgagcaacacgtaccacagtacggtaactaggaaggacgaccgtagaacgtacgtacgcgaacggaaccgaccggtaccgtaacttaagttccgtacggcggacgtaaaacggaacggtaaaaccggtaaaaggtcggtaaacggttaacggggtacggttaaccgggggaacaaccgaagtacggaaccgtacccgggg

SEQ ID NO: 440917 - DNA, 720 bp, Homo sapiens
  misc_feature: GZ8MTXP02GUTS6.10.88.H11.1.454.CMB.2.raw
  modified_base (211)..(211): a, c, t, g, unknown or other
  modified_base (294)..(294): a, c, t, g, unknown or other
tcagcatagtagtgcacgaccggtgctcgatttagcgacagcgagaacacacaaaggggacccaaaaaccacacccctccttgggagaatcccctagatcacagctcctcaccatcggactggacctggagcatccttttcttggtggcagcagcaacaggtgcccactcccaggttcagctggtgcagtcgtggggctggaggtgaaggngcccgtggggcctcgagtgaagatctccgtgcgaggtcttcgtggttaccacctttaacacctatggcactctccgtgggtcncgacgacggcccctaggacaaggcgttggaggtgggggtggggtcggtacgaggtccgtaccgttaaccgtaaggtttcggacctaacgtaactaaaactttagtacgacaacgaaggtaacgttaccgagggaacaacggagtaccaccaatcgaaccaacacgaaccacacgtacccaacgacgaccaacgaaccgaccttaaccgagtaacgggaaaccgtaggaacgggacgtacccgtaggaacgtacgttaccgtaacggaacccgaaccggtacccgggtacccgttaacgttacttttaccggacggtaccgacggaaacgggtaaacggtaaacggttaaaaacggtcggtaaacgggttgggtaaacggggttaacccgggggaactacggtacgaccggtaaccgtaacccgggg

SEQ ID NO: 440918 - DNA, 640 bp, Homo sapiens
  misc_feature: GZ8MTXP02HADDE.10.88.H11.1.454.CMB.2.raw
  modified_base (287)..(287): a, c, t, g, unknown or other
  modified_base (381)..(381): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatctcctgcgaggcttcgtggttacacctttaacacctatggcatctccgtgggtncgacgacggcccctaggacaaggtacgttggaggtggggtggggtggtcgaggccgtacttaaccgaaggttcggactaacgaactaaatttancgacaacgtagtaacgtacgaggaacagacgtaccactagacgaacccacgaacgaccaactacgaccgaacgacgaccaacgacgtaccctaagacgtaacggaacgtaggacggacgtaccgtagggaactagtacgacggaacgacggtaccgtacgttattcgtttcgcgacggacgaacggtaacggtaaacgtaaacggtcggtagggttaacggtacgggtaccggggacacgacggtacgacgtaccgggg

SEQ ID NO: 440919 - DNA, 697 bp, Homo sapiens
  misc_feature: GZ8MTXP02ITHAO.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcagtgaagatctcctggcgaggtcttcgtaggttaccacctttaacaccttatggcatcctccgtgggtcgcgacgacggcccctaggacgaaggtcgttggaggtggggtggggtggtcacggtcgtacttaaccgaaggttcggacctaacaactaaaatttagtgaccaacgtaagtaaacgttccaggggaccaagacgtaccaaccagtacgaacccaacaacgaaccaacactaccgaacgacgaccaacacgaccctaagacgtacggaaactggaacggacgccgtaggaacgtaacgttcgacggaaccgtaaccgaccgggtaccgttagttacgtttcgtacggaccggtaacggaaaggtaaacggtaaaccggttaaaaagggtcgggtaaaccgggttaaggggtaaccggggttaccgggggaaccaacgtacggttacggaacccggtaacccggggg

SEQ ID NO: 440920 - DNA, 576 bp, Homo sapiens
  misc_feature: GZ8MTXP02IOYQN.10.88.H11.1.454.CMB.2.raw
  modified_base (131)..(131): a, c, t, g, unknown or other
  modified_base (262)..(262): a, c, t, g, unknown or other
  modified_base (280)..(280): a, c, t, g, unknown or other
  modified_base (350)..(350): a, c, t, g, unknown or other
  modified_base (354)..(354): a, c, t, g, unknown or other
tcagcatagtagtgcacgaccggtgctcgattttagcgacagcgagaacacacaaaggggacccaaaaaccacatccctccttgggagaatcccctagatcacagctcctcaccatggactggacctggancatccttttcttggtggcagcagcaacaggtgcccactcccaggttcagctggtgcagtctggggctggaggtgaagagccctggggcctcagtgaagatctctgcgaggtcttctggttacactttaacncctatgcatctcgtggtncgacacggcccctggacaggtcttggaggtgggtgggtggtcagcgtcttacgagttgactacacaattngcanagatccgagacagatccacatcgacacacgacacactaccacgacgacaacacgacctacaagtacggaaactaggacggacgaccgtagacggtatacgtagacgaaccgacggtaccgttattactttcgtcgacgtacggaagaacggtaaaccgttaaaagtacggtaacggttacggttaacggttaccgggggaactacgtacgtacggaacccgg

SEQ ID NO: 440921 - DNA, 605 bp, Homo sapiens
  misc_feature: GZ8MTXP02F0WZ0.10.88.H11.1.454.CMB.2.raw
  modified_base (379)..(379): a, c, t, g, unknown or other
  modified_base (425)..(425): a, c, t, g, unknown or other
tcagcatagtagtgcacgaccggtgctcgatttagcgacagcgagaacacacaaaggggacccaaaaaccacatccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttcgtaggttacaccctttaacacctatggcatctccgtggtgtccgacgacggccccgtggacaaggtacttggagtggggtggggtggtcgagccggtacgttaaccgaaggttggactacgaaccaaattangacacagtaacgttccgaggacagacgtccacatacgaccaacganacacactaccacgacgcacaagcctaacagtacggaactggacgaggacctaggaagctcgtacgaacgaccgacggtacgtatttacgttcgtgtcggacgaagtaacggtaaaacgaaaggttaggaacggtttacgggtaacggttacccgggggaactacgacgtacggaaacccg

SEQ ID NO: 440922 - DNA, 533 bp, Homo sapiens
  misc_feature: GZ8MTXP02HTC22.10.88.H11.1.454.CMB.2.raw
  modified_base (442)..(442): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacaccctttaacacctatggcatctcctgggtgcgacacggcccctggacaaggacttgaggtgggtggggtgggtcaggcgcttaccgaagttggctacacaaattatgcacagaagttcaggacagactcaccatcgaccacagaccacatccacgagcacacgcctacatagaactgaagagctgaganctagacgacacgacgtatattctgcgcgagacgtaacgtaaagtcgtagtaaggttacggtaccgggggtacacgatacgtacgtaaccgg

SEQ ID NO: 440923 - DNA, 662 bp, Homo sapiens
  misc_feature: GZ8MTXP02GCB5E.10.88.H11.1.454.CMB.2.raw
  modified_base (324)..(324): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcgagtgaagatcctccgtgcgaggtcttcgtcggttacctacctttaacactagtgctatctcgtggtcgcgacgcggccccgtaggacgaaggtcgttggnggtggggtggggtggcgagtcgacttaaccgagttcggactaactaagttaaactatcgactaacgtagtaaacgttcgaggtacaacggacgtaccaactagcgaaaccaaacgacgaacacactaccgacgacacgaacacgacctaacgagtacggaaacgtacggaagggacgtaccgtaggaacgtacgttacgacgaaccgaaccgtaccgggtaaccttagtttaacttcgtcggaccgaggaaacgtaaaggtaaaccgtaaaaggtcggtaaccgggtaaggttaccgggttaacgggggacacgttacgacggtaaccgtaaccgggg

SEQ ID NO: 440924 - DNA, 617 bp, Homo sapiens
  misc_feature: GZ8MTXP02FSA6J.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctccgtgggtgcgacgacggcccctggacaaggtcttggaggtggggtggggtgggtcaggcgtcttaaccgaaggttcggactaacaactaaaatttgtgacaacagtaaacgttacgaagggtacaaggagtaccaacctagtacgaccaacacgaccaacactaccaacgacgacacacgcctacacgtaggaacgtaggaggacgccgtaggagactcgtacgacgacgaccggtaccgttacgttacgtttcgtcggtacgacggaagtaacggaacggtaaaacgtggtaacggtaagggtacggttaccgggggactacgacgtacgacgtaaccggg

SEQ ID NO: 440925 - DNA, 633 bp, Homo sapiens
  misc_feature: GZ8MTXP02HWF5S.10.88.H11.1.454.CMB.2.raw
  modified_base (368)..(368): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtgcccactcccaggttcagctggtgcagtctggggctgaggtgaagagcccgtgggggcctcagtgaagatctcctgcgaggcttctggttacacctttaacacctatggcatctccgtgggtgcgacacggcccctggacaaggtacttggaggtggggtggggtgggtcgaggcgtcttaccgaaggttggactacaactaaattntgacaacgagtaacgttccgagggtaccaaggacgtaccaaccatacgacccaacaacgacaaccactacccacgacgacacacgaccctacagtacggaaacgtaggacgggacgactacgggacgtacgtccgtacggaccgacgaccggacctaattaacttactttacgtacggcggacggaaggaacggtaaacgtaaaaggtcggtaacggtacggggttacgggttacccgggggactacggacgttacggaacccgg

SEQ ID NO: 440926 - DNA, 608 bp, Homo sapiens
  misc_feature: GZ8MTXP02JALY4.10.88.H11.1.454.CMB.2.raw
  modified_base (288)..(288): a, c, t, g, unknown or other
  modified_base (343)..(343): a, c, t, g, unknown or other
  modified_base (350)..(350): a, c, t, g, unknown or other
  modified_base (503)..(503): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttcgtggttacacctttaacacctatggcatctccgtgggtgcgacncggcccctggacaaggcttggaggtgggtggggtggtcagcgcttacagtgctanacaattngacacagaagttccaggacaagacgtacacctatacgaccaacagacacgactaccacgacgcaacacgacctacgagtacggaactaggaacggagcctaggaagtactcgtacgacggaacgtaccgggtaccgtaagttacgttttacgnggtaccggacggtaacggaacggtaaaccggtaaaaaggtcggtaacgggtaacgggtaacggttacccgggggaactacgacgtaccggtaacgtaacccgggg

SEQ ID NO: 440927 - DNA, 676 bp, Homo sapiens
  misc_feature: GZ8MTXP02HG3U4.10.88.H11.1.454.CMB.2.raw
  modified_base (449)..(449): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcattcctttttcttggtggcagcagcaacaggtcgcccactcccaggttcagctggtgcagtcgtgggctggaggtgaagcgcccgtggggcctgagtgaagactctcgtgcgtagtcttcgtacggttaacctacctttaacacctagtcggactagtccgtccggtgggtcgacgacgacggtaccgtaggaacgaaggtcgttaggaggtggggtggggtcggtcgaggtccgtacgttaacgaaggtttcgaactaacgaaacttaaagttacgcgacaacgtaagtaacgttaccgagtacagtacgtaccaacngacaacacagaaccacacacccgaacgacaccaacgtacgacctagagtaacgaacgtggacggtacgcgttaggatacgtacgacgaaccgacgtacggtaccttagttaccgttcgacggtaccggaacggaaacggtaaacggtaaacggttaaacggtcggttaacgggtaacggtacgggggtaaccggggacaaacggtacggtacgaacccggaccgggg

SEQ ID NO: 440928 - DNA, 651 bp, Homo sapiens
  misc_feature: GZ8MTXP02F9V3U.10.88.H11.1.454.CMB.2.raw
  modified_base (598)..(598): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagagcccgtggggcctcagtgaagatctctgcgaggtcttctggttacacctttaacaccttatggcatctccgtgggtgcgacgacggtcccctaggaccaaggtcgttggaggttggggtggggtgggtcaggtccgtacgtttaacccgaaggtttcggaccttaaacgaactaaaatttacgtcgactaaaccgaagtaaaccgttccgaggggtaccaaggtacgtacaacccgataccgaacccacaagtaccacactaccgaagacacaacagacctacagtacggaaactgggaaacgcgcctagaagtagtcgaggaaccgacggaccggtacctattcgtttacgcggtccgaacgaagtaaacggtaaacgttaaaacggnggtaacggtaaggggtaaccggtaccgggacacgtacgtacggaaccgtcggg

SEQ ID NO: 440929 - DNA, 513 bp, Homo sapiens
  misc_feature: GZ8MTXP02FGBGS.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacaggcccctggacaaggcttgagtgggtggggtggtcagcgcttaccaagttggctacacaaattatgcacagaagttccaggacagagtcaccatgaccacagacacatccacgagcacacgcctacatggaactgaggagcctgagatctgacgacacggccgtatatttctgcgcgagagacgtaaaacgtgacgtggtagttccgggggacacatcgacaccgg

SEQ ID NO: 440930 - DNA, 613 bp, Homo sapiens
  misc_feature: GZ8MTXP02H8TTV.10.88.H11.1.454.CMB.2.raw
  modified_base (360)..(360): a, c, t, g, unknown or other
  modified_base (365)..(365): a, c, t, g, unknown or other
  modified_base (374)..(374): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttggagtggggtggggtggtcaggcgtcttaccgaggttggctacgactaaattangacanagaagttcngggacagagtcaccatacgaccaacagacacgactaccacgacgacaacacgacctacacgtaggaacgtgaacgggtgacctaggacgtatcgtacgaacgacgacggtaccgtagttacgtttacgtcggcggacggaaagtaacggtaacggtaaaaacggttcggtaacggttaacggggttaacggttaaccggggggtacctaacggtaacgtacggtaaccgtaacccgggg

SEQ ID NO: 440931 - DNA, 648 bp, Homo sapiens
  misc_feature: GZ8MTXP02H3YIC.10.88.H11.1.454.CMB.2.raw
  modified_base (382)..(382): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagtatctcctgcgaggcttctggttacacctttaacacctatggcatctccgtgggtcgcgacgacggcccctggaacaaggtacgttggaggtggggtgggttgggtcaggcgtccgtttaaccgaaggttcggactaacgaactaaatttancgacaacgaagtaacggttccaggggaaccaggacgtacacctagtcgaaccacaagacaacactaccacgacgacaacgacgacctacagtcggaaactaggaaggacgaccgtaggagacgttacgacggaaccgacgaaccggtaccgttattacgtttcgtacggtaccggaccgtaaggaaacggtaaacgtaaaacggttaggaaccggttaagggtacggttaaccgggggactacgtacgtacggtaaccgaccgggg

SEQ ID NO: 440932 - DNA, 715 bp, Homo sapiens
  misc_feature: GZ8MTXP02HGUR7.10.88.H11.1.454.CMB.2.raw
  modified_base (294)..(294): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggtcttcgtggttactacctttaacacctatggcatctccgtgggtcgcgacncggcccctaggacaggtcgttggaggtggggtggggtggtcaggcgtacgttaaccgaggttcggcctaacgaactaaatttagacgacaacgtagtaaacgttccgaggtacaaggacgtaccaacccgagtacgaacccaacgacgaccacgactaccaacgacgaccaacgacgacctaacacgtacggaaactggaacgggtacgacccgtaggaacgtacgttaccgacggaaaccggtaaccgtaccgggtaccgttaacgtttaacgttttcggtacgggtaccggtaaccggaaaggtaaacggtaaaaccggttaaaaacggttacggttaaaggttaacgggttaacggggtttaaccggggtttacccggggggaaacttaaccggaacgtttaacgggtaaaccccggg

SEQ ID NO: 440933 - DNA, 694 bp, Homo sapiens
  misc_feature: GZ8MTXP02I8UNZ.10.88.H11.1.454.CMB.2.raw
  modified_base (211)..(211): a, c, t, g, unknown or other
  modified_base (298)..(298): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagngcccgtggggcctgagtgaagatctcctgcgaggtcttcgtggttaacctacctttaacaccttatggcattccgtccgtggggtcnccgaacgcgggcccctaggaaccaaggtaccgtttggagggttgggggtagggggtcggtcgaaggccgtacttaaccgaaggtttcggactaaacaactaaaattgtcgacaacgtaggaaacgttccgaggtaccaaggtacgtaccaacctagtacgaacccaacgacgaacaacgactaccaacgacgacaacacgtaccaacgagtacggaactaggaacggacgaccgtaggaacgtaacgtcgtacggaaccgacgaccggtaccgttaagttacgtttcggacggtacggacggaaaggtaaacggtaaacggttaaaacggtcggtaacggttaacggggtaacgggttaccgggggacaacgtacggtacgaaccgtaaccggggg

SEQ ID NO: 440934 - DNA, 577 bp, Homo sapiens
  misc_feature: GZ8MTXP02HVPGK.10.88.H11.1.454.CMB.2.raw
  modified_base (283)..(283): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcgagtgaagatctcctgcgaggtcttctggttacacctttaacacctatggcatctcctgggtncgacacggcccctaggaacaaggactttggaggtggggtcggggtggtcaggccgtactttaaccgaaggttcggactaacaactaaattatgacaacagaacgttccgagggacagagtccaaccatcgaaccacaacgacacgactaccaacgagccaacacgacctacagtaggaactgaacggagcctaggagatcgacgacgacgacggactatatttcgagtcgacgagacgaacgtaaagtgaacgtaaggtacggttaccgggggactacgagtcgaacgtaccgg

SEQ ID NO: 440935 - DNA, 606 bp, Homo sapiens
  misc_feature: GZ8MTXP02HK5Z4.10.88.H11.1.454.CMB.2.raw
  modified_base (290)..(290): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctggcgaggtcttcgtggttacacctttaacacctatggctatctccgtgggtcncgacacggcccctaggacaggtcttggaggtggggtggggtggtcaggcgtacttaccgaaggttcggactaacgaactaaattatcgacacgtaagtaacgttccgaggtacagacgtccacatgaccacagacacactccacgagcacgacgacctacgataggaactagacggacgccgtagagtactcgagaacgacgaccggtaccgtattacgtttcacggtcgacggtaagaacggtaacggtaaaacgtcggtaacggttaaggtacgggttaccgggggaaactacgtactacggacgtacccgggg

SEQ ID NO: 440936 - DNA, 635 bp, Homo sapiens
  misc_feature: GZ8MTXP02II9AN.10.88.H11.1.454.CMB.2.raw
  modified_base (207)..(207): a, c, t, g, unknown or other
  modified_base (297)..(297): a, c, t, g, unknown or other
  modified_base (372)..(372): a, c, t, g, unknown or other
  modified_base (447)..(447): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctggggctggaggtgaagngcccgtggggcctcgagtgaagatctcctggcgaggtctttcgtggttaacctaccttttaaacaccttatcggacatctccgtgggtcncgacacggcccctaggacaaggcttggaggtgggtggggtggtcagcgtacttacgagtgactaacactaattangacatagaacgttccgaggacagacgtacaccatacgaccacagacacactacaacgacgacaacgacaccctanagtaggaactaggacggacgccgtagaacgtagtacgacgaaccggacgacggtacctaagttacgtttacgtacggtccgacggtaaaggaaacggtaaacgtaaaaacggttggtaaacgggttaagggttacggggttaacccgggggaactaaccggtacggtacggaaccggtaacccggggg

SEQ ID NO: 440937 - DNA, 651 bp, Homo sapiens
  misc_feature: GZ8MTXP02HOPFF.10.88.H11.1.454.CMB.2.raw
  modified_base (232)..(232): a, c, t, g, unknown or other
  modified_base (270)..(270): a, c, t, g, unknown or other
  modified_base (386)..(386): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagcgcccgtggggcctgagtgaagntctcctgcgaggtcttcgtggttacctaacctttaacnccttagtcggctacttcctccgtggggtcgaccgacgacggcccctaggacaaggtcttggaggtggggtggggtggtcaggcgtacttacgaggttcgactaacgaactaaattngacaacgtagtaacgttcgagggtacaggtacgtaccacagtgaacgacacgacgacaacactaccaacgacgacacgacgacctacgagtacggaacgtaggaaggacgaccgtagagtacgtacgacgaaccggaacgttttaccggacgttacgttacgtttcgtacgtaccggacgaaggtaaacggtaaacgtaaaaggtacggtaacgggttacggggtaacgggttaccgggggaacgacggtacgtacggaacccgg

SEQ ID NO: 440938 - DNA, 600 bp, Homo sapiens
  misc_feature: GZ8MTXP02FIWFA.10.88.H11.1.454.CMB.2.raw
  modified_base (357)..(357): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacaccttaacacctatggcatctccgtgggtgcgacacggcccctggacaaggcttggaggtggggtgggtggtcagcgcttaccgaaggttcgctacgacaaattntgcacagacgttccaggacagatcacatcgaaccacagacacactaccacgagcacacgcctaacagtacggaacgtagacggacgccgtagaagacgtacgtacggaccgaacgacgggtaccgttaagttactttcgcgtacggaccggaaggaacggtaaacggttaaaacggtcggtaacgggttaacggttaacgggttaccggggggactacgtacggtacgaccggtaacccgggg

SEQ ID NO: 440939 - DNA, 747 bp, Homo sapiens
  misc_feature: GZ8MTXP02JFJRM.10.88.H11.1.454.CMB.2.raw
  modified_base (208)..(208): a, c, t, g, unknown or other
  modified_base (285)..(285): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctggaggtgaagngccgtggggcctcgagtgaagatctcctgcgagtcttcgtgttactaccttaacacctatggcatcgtcgtgggtcncgacgacggccccgtaggaacgtaggtcgttggaggttggggtggggtcggtcgagtccgtacttaacgtaaggttcggactaaacgtaactaaagtttagtaggaccaacgtaaggtaaacgttaccgagggtacgaagtaacgtaccaaccgtaataccgaaccaaacaacgaacaccaactaccgaacgaacgaccaaacgacgtacctaacgagtaacggaacgtagggaacggacgtaccgtaagggtacgtacgttaccggaggaaacccggtacgtaaccgggtacgtttaacttacgtttacggaccggtacggaacggtaaaggtaaaacggttaaaccgggttaaaaaaggttccgggtaaaacggggtttaacgggggttaaacccgggggtttaaccgggggaaacctaacgggtaacggtaccggggttaacccgtaaaccccgggggg

SEQ ID NO: 440940 - DNA, 748 bp, Homo sapiens
  misc_feature: GZ8MTXP02IQ4FC.10.88.H11.1.454.CMB.2.raw
  modified_base (210)..(210): a, c, t, g, unknown or other
  modified_base (224)..(224): a, c, t, g, unknown or other
  modified_base (232)..(232): a, c, t, g, unknown or other
  modified_base (288)..(288): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagngcccgtggggcctnagtgaagntctctgcgaggtcttctggttaccacctttaacacctatggcatctccgtgggtcncgacacggcccctaggacaaggtacttggaggttgggggtaggggtggtacacggtccgtaccgtttaaccgaaggtttcggaccttaaacggaacttaaaagtttcgtcgacctaacgaaggtaaacgtttccgaggggtaacaaggtacgtccaacctagacgaacccacagacacgactaccgaacgacgaccaacgacgacctacaacgtacggaaacgtggaaggtacgaccgtaggaacgtacgtacgtaacggaaccggtaacgaaccgggtaccgttaaacgttacgttttaccggtacggtaccgggtaacggtaaacgggaaaacggttaaaaccgggttaaaaacggggttaccgggttaaacggggttaacggggtttaaccggggtttaacccggggggtaaaccaaaccggtaaccgttaaccgggaacccgttaaaccccggggg

SEQ ID NO: 440941 - DNA, 633 bp, Homo sapiens
  misc_feature: GZ8MTXP02IV1EX.10.88.H11.1.454.CMB.2.raw
  modified_base (440)..(440): a, c, t, g, unknown or other
  modified_base (446)..(446): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctccgtgcgaggtcttctggttaacctacctttaacaccttatcggcatctccgtgggtgacgacgacggcccctaggacgaaggtacttggaggtggggtggggtggtcgaggtcgtacgttaaccgaaggtttggactaacgaactaaaattatagacaacgagtaacgttcagggacaggacgtacaccatcgaaccacagacacanccaganacacacgacctacagtacggaactaggaaggtacgaccgtagagtacttcgagacgaacgaccggtaccgttaattactttcgacggtaccggacggtaaaggaacgtaaacgggttaaaacgtaggtaacggttaaggggtaacggggttacgggggacacgtacggtacgaaccggtaaccgggg

SEQ ID NO: 440942 - DNA, 765 bp, Homo sapiens
  misc_feature: GZ8MTXP02HXMLZ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctggaggtgaagacgcccgtggggcctcgaggtgaagatctcgtgcgaggtcttctggttacctacctttaacacctatggcatctccgtggtcgcgacgcggcccctaggacaggtactggaggtggggtggggtcggtcgaggcgtacgttaccgaggttcggacctaacgaaactaaagtttacgtacgaccgtaacgaaaggttaaccgttaccggaacgggaaccgtaaacggtacggttaccccaaaacccggtacgtaaccgaaacccccgaaacgaaaccggaaacccaaacctaaacccgttacccgaaacccgggtaaaccggtacccaaaccgaaaccggtaccccttaaacgaaacgttacggaaaccggttacgggaacgggtacgtacccgtaggacgaacttccggaacggaaccggacgacccgggtaacttacgttactttcgtcggaccggtacggaacgtaaagtaaacgggtaaacgtaggtaacgggttcggggttaacgggttaacccgggggactaaccgtacgtacggtacccgtaaccggggg

SEQ ID NO: 440943 - DNA, 651 bp, Homo sapiens
  misc_feature: GZ8MTXP02FR1TI.10.88.H11.1.454.CMB.2.raw
  modified_base (231)..(231): a, c, t, g, unknown or other
  modified_base (284)..(284): a, c, t, g, unknown or other
  modified_base (333)..(333): a, c, t, g, unknown or other
  modified_base (547)..(547): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagagcccgtggggcctcagtgaagntctcctgcgaggtcttctggttactaccttaacactatgcatctcgtgggtcncgacacggcccctaggaccaaggtcttggaggttggggtggggtggtcnggcgcttaaccaggttcgactacactaaacttgcgacacgaagtaacgttaccgaggtacaaggtacgtaccgaacctaagtcgaaccacgaacgaaccacacctacgacgacgaccaactaccgacctaacgagttacgggaactggaacggacgtccgaggacgacgttcgaacggaacccgaacggaccgtaccgttaattacgtttacgnggaccgacggtaaggaacggtaaaacggttaaaacgcgggttaaggtaacgggtttacggggtaaccgggggtacctaggtacgtaccggaccgtaaccggggg

SEQ ID NO: 440944 - DNA, 666 bp, Homo sapiens
  misc_feature: GZ8MTXP02GMNDB.10.88.H11.1.454.CMB.2.raw
  modified_base (389)..(389): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagatctcctggcgaggtcttcgtaggttacctacctttaacaccttagtcggcatccgtccgtgggtcgacgacgcggcccctaggaacaaggcgttggaggtggggtggggtggtcaggcgtacttaaccgaaggttcggactaacgaactaaaattncgacaacgaacggtaacgttcccgaggggtacaaggtacgtaccaaccgatacgaacccaacaacgacaacaacaccaacgacgaccaacaacgacctaacgagtaacggaacgtagggaacggacgaccgtagaacgactacgtacggaacgtaaccgtacggtaccgtaacttaacgttcgtacgacgaacggaagaaacggtaaacgtaaaaggtacgtaacggtaagggtacgggttacgggggacaacgggggactacggacgtaaccgggg

SEQ ID NO: 440945 - DNA, 646 bp, Homo sapiens
  misc_feature: GZ8MTXP02GITZL.10.88.H11.1.454.CMB.2.raw
  modified_base (283)..(283): a, c, t, g, unknown or other
  modified_base (354)..(354): a, c, t, g, unknown or other
  modified_base (359)..(359): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctccgtgggtncgacgacggcccctggacaaggcttggaggtggggtggggtggtcagcgcttacgagttgctacacaattngacanagacgttcgaggacagactcgacatacgaccacagacacactaccaacgacgaccacacgacctacagtacggaactaggacggagccgtaggaacgacgttacgacggaaccggaaccggtaccgggtacccgttaagttacgttttaccggtacggaccgggaccggaaggtaaacggtaaaaccgggttaaaaagggtacgggtaaacggggttaacggggttaaccggggttacccggggggaaactaaccggtaacggttacgggaaccgtaaccccggggg

SEQ ID NO: 440946 - DNA, 526 bp, Homo sapiens
  misc_feature: GZ8MTXP02FH9PL.10.88.H11.1.454.CMB.2.raw
  modified_base (281)..(281): a, c, t, g, unknown or other
  modified_base (393)..(393): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtcncgacacggcccctggacaaggctgaggtggggtggggtggtcagcgctacgaagtgctacacaaattatgcacagaagttcaggacagagtcaccatgaccacagacacacncacgagcacacgcctacataggaacgtgaggagcctagaagatctagacgacacggccgtatacttctgcgacgagacgacgtaaaagtgacggtaaggtacgtacgggggtacacgacgtacgacgtaccgg

SEQ ID NO: 440947 - DNA, 682 bp, Homo sapiens
  misc_feature: GZ8MTXP02IUZGA.10.88.H11.1.454.CMB.2.raw
  modified_base (289)..(289): a, c, t, g, unknown or other
  modified_base (294)..(294): a, c, t, g, unknown or other
  modified_base (376)..(376): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtgggggcctcgagtgaagatctccgtgcgaggtcttcgtggttaacctaccttaacacctagtggcatctcgngggtncgacacggcccctaggacgaaggtcttggaggtggggtggggtggtcgaggcgtcgttacgagttggactacgaactaattntcgacacgagaacgttcaggacagagtaccaccatacgaaccacagacacactaccacgacaccaacgacgaccctacgaacgtacggaaactggaaggacgaccgtaggagtacgtacgtacggaaccgaccgtaccggtaccgttaacgtttacgtttacggtacggtccggaacggtaaacggtaacggtaaaaccggttaaaaacgggtacggtaacggggttaacggggttaaccgggggtttaacccggggggaaaccttaaccggtaaacggtaccggttaaacccggtaacccggggg

SEQ ID NO: 440948 - DNA, 583 bp, Homo sapiens
  misc_feature: GZ8MTXP02I0TGR.10.88.H11.1.454.CMB.2.raw
  modified_base (208)..(208): a, c, t, g, unknown or other
  modified_base (287)..(287): a, c, t, g, unknown or other
  modified_base (364)..(364): a, c, t, g, unknown or other
  modified_base (369)..(369): a, c, t, g, unknown or other
  modified_base (405)..(405): a, c, t, g, unknown or other
  modified_base (435)..(435): a, c, t, g, unknown or other
  modified_base (506)..(506): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagngcccgtggggcctcgagtgaagatctcctgcgaggtcttcgtggttacacctttaacacctatggcatctccgtgggtncgacgcggcccctggacaaggcttggaggtggggtggggtggtcagtcgcttaccgagttcgactacgactaaattngacanagtaacgttcagggacagcgtaccacatacgaccanacgacacactccacgagcacacgacctaanacgaggtaactggaaggtacgccgttaggacgtagtcgtacggaacgacgtacggtaccgtattcgttcgngtacgcgaagacggtaacgtaaagtcggtacggttaaggtacgggtaccgggggacagtaacgtcgaacgtaccggg

SEQ ID NO: 440949 - DNA, 740 bp, Homo sapiens
  misc_feature: GZ8MTXP02FTLYN.10.88.H11.1.454.CMB.2.raw
  modified_base (249)..(249): a, c, t, g, unknown or other
  modified_base (272)..(272): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctcctgcgaggtcttntggttactaccttaacacctagngcatctccgtgggtcgcgaccgacggcccctaggaacgaaggtacgttgggaggttggggtgggggtgggtacaggtccggtacttaccgtaaaggtttcggacttaaacaacgtaaaagtttagtacgactaacgtaacggtaaacggtttacccgagggaaccgaaggtacgtacccaacccgtaagtaccgaaacccaaacaaaacaacctacgacccaacgacgaccaacacgtaccctaaacgagacgggtaaacctgggaaacggacgtaccgaggtaacggtacttaccgacgaaccggaacgtaccggggaccttaagtttacgtttcgaaccggtcgggaaccgtaagggtaaacggtaaaacgggttaaaacggtcggtaacgggggtttacgggtaacgggggttacccgggggaaactacggtaacgttacggaaacccggtcgggtaaccggggg

SEQ ID NO: 440950 - DNA, 626 bp, Homo sapiens
  misc_feature: GZ8MTXP02I8Z1U.10.88.H11.1.454.CMB.2.raw
  modified_base (378)..(378): a, c, t, g, unknown or other
  modified_base (437)..(437): a, c, t, g, unknown or other
  modified_base (441)..(441): a, c, t, g, unknown or other
tcagcatagtagtgcacgaccggtgctcgatttagcgacagcgagaacacacaaaggggacccaaaaaccacatccctccttgggagaatcccctagatcacagctcctcaccatggactggacctggagcatccttttcttggtggcagcagcaacaggtgcccactcccaggttcagctggtgcagtctggggctgaggtgaagacgcccgtggggcctcgagtgaagatctccgtgcgaggtcttcgtggttaccacctttaacgcctatggctatctccgtggtgcgacgacggcccctggacaagtacgttgaggtggggtggggtggggtcacgcgtcttacccgaagttggactacaaccctaaatttagngacaactaggaaagttccgaggactaacggagtacacctaagtcgaaccacgacgaacncaanacccgacgacgacaacgacgacctaacgaatcggaaacgtcggaggacggcctagacgacgtacgtacgacgacgaacggtccgtaagttaacttcgtacgcggacgaacgaaggaacgtaaaacggtaggaaccggttagggttaacggttaccgggggaactacgaacgtacggtaacccggg

SEQ ID NO: 440951 - DNA, 684 bp, Homo sapiens
  misc_feature: GZ8MTXP02IJE25.10.88.H11.1.454.CMB.2.raw
  modified_base (209)..(209): a, c, t, g, unknown or other
  modified_base (416)..(416): a, c, t, g, unknown or other
  modified_base (487)..(487): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagngcccgtgggcctcagtgaagatctcctgcgaggtcttcgtcggttaacctacctttaaacacctagtcggactacttctccgtgggtcgacggaccacggtccccctaggaaccgaaggtaccgttagggaggtgggggtcgggggtaggtacgaggtccgttaccgttaaccgaaggtttcggacctaaacgtaactaaagtttancggacaaacgtaggtaaacgttacccgaggggacaaggtaaccgttaccaacctaagccgaaaccaacganaacctacaactaccgaaacgagaccaacagacctaacagtaagaacgtaaggacggtaacgtacttaagactacgtacgacgacgtacggcttaagtacgtttcgacggtacgacggagtaaacggtaaacgtaaacggtacggtagttagggtaacgggtacccgggggataccgagtcgaacgtacggtacgggg

SEQ ID NO: 440952 - DNA, 672 bp, Homo sapiens
  misc_feature: GZ8MTXP02IRPCT.10.88.H11.1.454.CMB.2.raw
  modified_base (222)..(222): a, c, t, g, unknown or other
  modified_base (358)..(358): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtctggggctgaggtgaagagcccgtggggcctnagtgaagatctctgcgaggtcttctggttaccacctttaaacacctatggcatctcgtggtgcgacgacggcccctggacaaggcttggaggtggggtgggtggtcaggcgtactacgagttgctacactaattangacacgagtagttccgaggacaggacgtcaccatacgaccacagacacactaccacgagccaacacgacctacagtacggtaaccgtaggacgggacgaccgtagggaacgtacgtcgtacggaaccggaaacgtacccgggtaacgtaactttacgtttaccgtacggtaccggaacgggtaaaggaaacgggttaaaccggttaaaaacggttcggggttaaaccggggtttaacggggtttaaaccgggggtttaaccggggggtaaaccaaccggtaacggttaccgggaaacccggttaaccccggggg

SEQ ID NO: 440953 - DNA, 574 bp, Homo sapiens
  misc_feature: GZ8MTXP02GJGQ0.10.88.H11.1.454.CMB.2.raw
  modified_base (357)..(357): a, c, t, g, unknown or other
  modified_base (379)..(379): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttcgtggttacacctttaacacctatggcatctccgtggtgcgacaggcccctaggacaaggcttgaggtggggtggggtggtcagcgtcttaccgaagtcgctacacaaattangacacagaagttccaggacagngtacaccatcgacacagacacactaccacgagacaacacacctacataggaactagaggacgcctaggaactagtacgtacgaccgacgaaccggaccgtatactttacgtcgtacggacgaaagacggtaacgtaaaaggtcgtaacggtaaggtacggttaccgggggaactaccgaagtcgacgtacccggg

SEQ ID NO: 440954 - DNA, 660 bp, Homo sapiens
  misc_feature: GZ8MTXP02JWW9G.10.88.H11.1.454.CMB.2.raw
  modified_base (287)..(287): a, c, t, g, unknown or other
  modified_base (371)..(371): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctgaggtgaagagccctggggcctcgagtgaagtatctcctgcgaggcttcgtggttacacctttaacacctagtggcatctccgtggggtnaccgacgacggccccgtaggacaaggtacttggaggtggggtggggtggtcaggcgtacttacgaggtgactacaactaaattngacaacgagtaacgttcgaggacagacgtcaacagtcgaaccacacgaacacacgccacgacaccaacacgacctacgagtaggaacgtaggaggacgccgtagaacgtacgtacgtacgaacgtacgaccgggtaccgttaacgttacgtttaccgtaggaccggtacggtaaacggaaacggtaaaaccgggtaaaacggttaccggtaaccgggttaacggggttaacggggtttaacccgggggaactaaccggtaacggttaaccggaaccggtaacccggggg

SEQ ID NO: 440955 - DNA, 619 bp, Homo sapiens
  misc_feature: GZ8MTXP02IWNVI.10.88.H11.1.454.CMB.2.raw
  modified_base (283)..(283): a, c, t, g, unknown or other
  modified_base (361)..(361): a, c, t, g, unknown or other
  modified_base (464)..(464): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgccactcccaggttcagctggtgcagtctggggctggaggtgaagagcccgtggggcctcgagtgaagatctcctgcgaggcttctggttacaccttaacacctatggcatctccgtgggtncgacacggcccctggacaggctggaggtggggtggggtggtcaggcgtcttaccgaggttcggactacgactaaattngcagagaacgttcccagggtactaagacgtccaacctatacgaacccaacagaacccacactccaacgacacgacacgcctacagtaggaacgtgaagggtanaccgtagaacgtatacgtacgaacggacgtaccggtaccggttactaactttccgacggtacggaccggtaaaggaacgtaaacggtaaaaggttcggaacggttcggggttaacggttaccgggggaactacgacgttacggacgtacccgggg

SEQ ID NO: 440956 - DNA, 753 bp, Homo sapiens
  misc_feature: GZ8MTXP02GJCS6.10.88.H11.1.454.CMB.2.raw
  modified_base (233)..(233): a, c, t, g, unknown or other
  modified_base (290)..(290): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagacgcccgtggggcctcgagtgaagntctcctgcgaggtcttcgtggttactacctttaacacctatggctatctcgtgggtncgacgcggccccgtggacgaaggtcgttaggagggttgggggttaggggttggggtacgacggtccggtaccgtttaacccgtaagggtttcggactaacctaaacgttaaaagtttagtacgacaacgaaggtaacgttaccgacgggacaggtaacgtaccaacctagtacgaacccaacgacgaaaccaccaacgtaccgaacgacgaccaacgacgacctacgtaagacggtaaacgtaggacggaacgccgtaggagtacgtacgtacggaccgtacggaaccgggttacgtttaacgttacgtttacggtcgggtaccggaacggaaacgggtaaacggttaaaacggttaaaacggggttcggttaaaccgggggtttaacggggttaaccgggggtttaacccggggggaaactaaccggtaacggttacccggggaaccggttaaccccggggg

SEQ ID NO: 440957 - DNA, 685 bp, Homo sapiens
  misc_feature: GZ8MTXP02IXS1H.10.88.H11.1.454.CMB.2.raw
  modified_base (286)..(286): a, c, t, g, unknown or other
  modified_base (370)..(370): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggtcttctggttacacctttaacacctatggcatctccgtgggtncgacacggcccctaggacaaggacttggaggtggggtggggtggtcaggcgtcttaccgaagttcggactaacaactaaattgngacaacgtagtaacgttccgagggtaccaaggtacgtaccaacctaagtacggaaacccaaacaacgaaccaactaactacccaacgaacgaccaacgaacgtaccctaacgaacgttaacgggaaaccgttagggaacgggtacgaccgtacggaagtacgtacgtacggaaccgaaccgaccggtaccgttaacttacgtttacgcggtacggacggaacggaaggtaaaaccggtaaaaggtacggtaacgggttaacgggttaacgggttaccgggggaacaacggtacgtacggaaccgtaacccggggg

SEQ ID NO: 440958 - DNA, 689 bp, Homo sapiens
  misc_feature: GZ8MTXP02H8IWF.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtcgtgggctggaggtgaagacgcccgtggggcctcgagtagaagtactcctccgtggcgaggtctttcgtggttacctaacctttaacacctatggctactccgtccgtggggtcaccggacgccggtccccgtagggaactaaagggtacgtttggacgggtgggggtaggggtcggtacgacggtcgtacttaaccgaaggttcgacctaacaactaaatgtacgacacgagtaacgtcgagacagactcaacagacaaccacgacgactacactaccgacgaacgaccaacgacgaccgtacgagtacggaaacgttacggaaacggtacgaccgtaggagtactacgacgaacgtaacgaccgggtaacttaacgttacgtttacgacggtaccggaggaacggtaaacgtaaacggtaaaacgtcggtaacggttaacggggttaacgggttaccgggggaaactacggtacggttaacggacccgtaaaccggggg

SEQ ID NO: 440959 - DNA, 625 bp, Homo sapiens
  misc_feature: GZ8MTXP02JEKOI.10.88.H11.1.454.CMB.2.raw
  modified_base (206)..(206): a, c, t, g, unknown or other
  modified_base (218)..(218): a, c, t, g, unknown or other
  modified_base (460)..(460): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctgggctgaggtgaagngccctgggcctnagtgaagatctcctgcgaggcttcgtggttacacctttaacacctagtcggactactctccgtgggtcgcgaccacggcccctaggacaacggtacttggaggtggggtggggtggtcgaggtcgtactaccgaagttcggactaacgaactaagttatcgaaccacgtaagtaaccgttacgacgggacaaggacgttacaacctagtacgaaccaacgagaccaacgtacaccgacgacnccaacacgtacctaacgacgtaggaacgtaggacggacgtccgtagagtacgtcgtacggaacgtacgaccggtaccgtagtacgtttacgcgcggacgtagaaacgtagtaaaacggtgtacggtaaggttacggtacggggactacgagtacgtacgtaccgg

SEQ ID NO: 440960 - DNA, 588 bp, Homo sapiens
  misc_feature: GZ8MTXP02JDX4W.10.88.H11.1.454.CMB.2.raw
  modified_base (209)..(209): a, c, t, g, unknown or other
  modified_base (287)..(287): a, c, t, g, unknown or other
  modified_base (370)..(370): a, c, t, g, unknown or other
  modified_base (406)..(406): a, c, t, g, unknown or other
  modified_base (415)..(415): a, c, t, g, unknown or other
  modified_base (422)..(422): a, c, t, g, unknown or other
  modified_base (471)..(471): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagngcccgtggggcctcagtgaagatctccgtgcgaggtcttcgtggttactacctttaacactatgcatctcgtgggtcncgacacggccctaggacaaggtcttggaggtggggtggggtggcaggcgtacgttaaccgaggttggacctaagactaaattntgacacgagtaacgttccaggacagacgtacactancgaccacanacacacncagacacacacgacctacgacgtacgaactaggacggacgccgtagganacgtcgtagaccgaacgacgtacgtagtacgtttcgtcggaccgacggaagaacgtaacgtaaacggtagacggtaagggttacggtaccggggacacgtacgtacgacgtaccggg

SEQ ID NO: 440961 - DNA, 789 bp, Homo sapiens
  misc_feature: GZ8MTXP02IKGWX.10.88.H11.1.454.CMB.2.raw
tcagcatagtagtgcacgaccggtgctcgatttagcgacagcgagaacacacaaagggacccaaaaaccacacccctccttgggagaatcccctagatcacagctcctcaccatggactggacctggagcattcctttttcttggtggcagcagcaacaggtcgcccacctcccaggttcagctggtgcagtctggggctggaggtgaagacgcccgtggggcctcgaggtgaagatctccgtgacgaggtcttcgtggttactaccttaacactatggcactctcgtggtcgcgacgacggccctaggaacgaaggtcgttaggacggtggggtggggtggtacgacggtccgtacttaaccgaaggtttcggacctaaacgtaactaaaatttactacgacaacgaagtaacgttacccgagggtacaaggtacctaccgaacctagtaccgaacccaaacgaacgaaccctaacaaccgtacccgaaaccgacacccgaaacaacgtaaccctaaacgaacggtaacggaaaccgtagggaacgggtaaccgccgttaaggaacgtacgtaccggttacggaaacccggaaaccggtaaccggttaaccgttaacgtttaaacgttttccggtacgggtaaaccggtaacggtaaaacggtaaacggtaaaaccgggttaaaaaacgggttcggtaaaacggggttaacgggggtttaaccggggtttaacccggggggaactaaaaccggttaacggtaacccggtaaaccggtaaacccggggg

SEQ ID NO: 440962 - DNA, 679 bp, Homo sapiens
  misc_feature: GZ8MTXP02GBTLZ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcagtgaagatctcctgcgaggtcttcgtggttaacctacctttaacacctatggctatctccgtgggtcgacgacgacggccccgtaggacgaaggtacgttggaggttggggtggggtggtcaggtccgtacttaaccgaggttcgactaacgaactaaatttagtcgacacgtaaggtaacgttccgagggacagacgtcaacatacgaccacacgacacacaccgagacgaccacacgacctacagtacggaacgtacggaaggacgtaccgtagaagtaacgttccgtaaggaccggaacgtaccggtaccgttaagttactttacgcggtaccggaccggtaaaggtaaacggtaaaacggttaaaacggtcgggtaaacgggttaacggggttaaaccgggttaaccggggggaacctaaggtacgtaacgggaccgtaaaccccggggg

SEQ ID NO: 440963 - DNA, 566 bp, Homo sapiens
  misc_feature: GZ8MTXP02GMRJP.10.88.H11.1.454.CMB.2.raw
  modified_base (367)..(367): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggctatctccgtggggtgcgacaggcccctggacaaggcttgaggtggggtggggtggtcaggcgtcttaccgaaggttggactacgacaaatttatgcanagtaacttccgaggacagagtccaccatcgaaccacagaacacactaccacgagacacacgcctacagtaggaactggaaggagaccgtaggagacgtacgtaggacgacgacggaccgtattagttctgcgacggagacggacgtaaaagtggacgtaagggtacggtaccgggggacacgacgtacgacgtaccggg

SEQ ID NO: 440964 - DNA, 626 bp, Homo sapiens
  misc_feature: GZ8MTXP02I0U47.10.88.H11.1.454.CMB.2.raw
  modified_base (382)..(382): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtctggggctggaggtgaagagcccgtggggcctcgagtgaagatctcctgcgaggtcttcgtaggttacacctttaacacctatggcatctccgtgggtcgcgacgacggcccctggacaaggacgttggaggttggggtggggtggtcaggccgtacttaccgaaaggtttggacctaacaactaaaattngacaacgagtaacgttcaggacagacgtccacatacgaccaacacgaacactacaccaacgacgacaacacgacctaacagtaggaacgtaggacggacgaccgtagacgtagtcgtacgacgacgaccggtacgtattacgtttcgtcggcggacgaaggtaacggtaacggtaaaaggtggtaacgggttaacgggttaacggtaccgggggaacacggtacgtacggaccgtaaccggggg

SEQ ID NO: 440965 - DNA, 638 bp, Homo sapiens
  misc_feature: GZ8MTXP02J167Z.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctgaggtgaagagcccgtggggcctcgagtgaagatctccgtgcgagtcttcgtggttacctaacctttaacacctagtcggcatcctccgtgggtcgccgacgacggcccctggaacaaggtacttggacggttggggtgggggtcggtcgaggcgtcgttaaccgaaggttcggacctaacaactaaattatgacaacgagtaacgttcgaggactaagacgtcaacccagtacgaaccaacgacgacacgtacaccgacgacgacacgactacctacagacggaaacgtggaacgtacgaccgtagaacgtactacggtacgaacgaccgacggtaccgtagttactttcgacggcgacggtaacgaacggtaaccgtaaaaggtcgtaacggtcgggttacggacgggggtacaacgtacgtacggaacgtacccgggg

SEQ ID NO: 440966 - DNA, 560 bp, Homo sapiens
  misc_feature: GZ8MTXP02FPHYR.10.88.H11.1.454.CMB.2.raw
  modified_base (308)..(308): a, c, t, g, unknown or other
  modified_base (336)..(336): a, c, t, g, unknown or other
  modified_base (398)..(398): a, c, t, g, unknown or other
  modified_base (421)..(421): a, c, t, g, unknown or other
  modified_base (446)..(446): a, c, t, g, unknown or other
tcagcatagtagtgcacgaccggtgctcgatttagcgacagcgagaacacacaaaggggaccaaaaccaacaccctccttgggagaatccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacactttaacacctatggcatctctgggtgcgacaggcccctggacaaggcttgaggtgggnggggtgggtcagcgcttaccaagttggntacacaaaattatgactacaagaacgtttcagggacaggtagtcaccatgaccacacgacanacgtacacgagcactagctaacntaggaactgaggagccgtagagtanctgacgaacgacggccgtagtaatttctagcgacggtagaagaaccggtaaaagtcggaacgtgggttaacggttaccggggggaaccagtaacgttacggaccttaaaccggg

SEQ ID NO: 440967 - DNA, 630 bp, Homo sapiens
  misc_feature: GZ8MTXP02FGK4Y.10.88.H11.1.454.CMB.2.raw
  modified_base (276)..(276): a, c, t, g, unknown or other
  modified_base (291)..(291): a, c, t, g, unknown or other
  modified_base (566)..(566): a, c, t, g, unknown or other
  modified_base (590)..(590): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcattccttttcttggtggcagcagcaacaggtgccccactcccaggttcagctggtgcagtcgtggggctgaggtgaagacgcccgtggggcctcgaggtgaagtatcctccgtgcggaggtcttctggttactaccttaacactangcatctcgtgggtcncgacaccggcccctaggacaaggtctggagggttggggtggggtggtcaggtccgtacgttaaccggtaaggtttcggactaacgtaactaaaacgtttgacggacaacgtaaggtaaaccgtttaccggagggaaccgaaggtacgtacccaacctaagtaccgaaacccaacgaacgaaccaacactaaccgacgacacgacaacgacctaacagtaggaaacgtaggacggacgcgtaggagactcgacgacgacgacgcttagtacttcgngcgacgaagacgaacgtaaacggngtacggtggtacggtacggggacactagacgacgaccggg

SEQ ID NO: 440968 - DNA, 680 bp, Homo sapiens
  misc_feature: GZ8MTXP02HQWXJ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagacaacaggtgcccactcccaggttcagctggtgcagtctggggctggaggtgaagagcccgtggggcctcgagtgaagatctcctgcgaggtcttcgtggttacacctttaacaccttatggcatctccgtgggtcgcgacgacggcccctaggacaaggtacttggaggtggggtggggtggtcgaggcgtcttaccgaggttcgactacacaaattatgacactaggtaacgttcagggactagacgtaccaccatacgaaccacacgacacactaccacgacgacacacgtacctacgagtacggaaactggaacggacgaccgttaggaacgtactaccgtacggaaccgaaccgaaccggttacccggttaattacgttttacgtacggtacggaccggaaagggtaaacggtaaaaccgggttaaaaagggttacgggtaacggggtttaacggggttaaccggggtacccggggggtaaaccaacggttacggttaaccggaaccggtaaaccccggggg

SEQ ID NO: 440969 - DNA, 714 bp, Homo sapiens
  misc_feature: GZ8MTXP02INCQF.10.88.H11.1.454.CMB.2.raw
  modified_base (285)..(285): a, c, t, g, unknown or other
tcagcatagtagtgcacgaccggtgctcgatttagcgacagcgagaacacacaaagggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctcctgcgaggtcttcgtgttactacctttaacactatgcatctcgtgggtncgacgacggcccctggacgaaggtcgtttggaggttggggtggggttggtcgaggtccgtaccgtttaaccgtaaaggttcggaacctaaacgtaaactaaaaagtttagtacgtaccaaacgtaaggttaaaaccggtttacccgaggggaaacctaaggaacgttacccgaaccctaagtaccggaaacccaaacgacgaaaccaacaacgtacccgaacgacgaccaacgacgacctaacgagtacggaacgtaggaacggtacgaccgtaggaacgtatacgtacggaaccgaacgtaccggtaccgtattaacgtttcgacggtacgacggtaaaggaacggtaaacggtaaaacggtacggtaacgggttaacggttaacggggttaccgggggacaacgtacgtacggaccggtaaccgggg

SEQ ID NO: 440970 - DNA, 677 bp, Homo sapiens
  misc_feature: GZ8MTXP02GXQ2G.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagccctggggcctcagtgaagatctcctgcgaggtcttcgtggttacacctttaacacctatggcatctccgtgggtgcgacacggccctggacaaggcttggaggtggggtggggtggtcgaggcgtcgttacgaaggttcggactactaactaaatttagtagaccacgtaaggtaaacgttacccgaggggtaaccaggtaacgttacccaacccgtaagtacggaaacccaacgaaggtaacccaacactacccgaacgacgacacacgtacctaacgagtacggaaactggacggacgtccgtaggacgtacgttacgacggaacgaacggtaccggtaccgttaagttacgtttcgtacggccggtaacggaaggtaacgtaaacgggtaaaacggtcggtaacggttaacgggttaacgggttaccgggggactacggtaacgtacggaacggtaacccggg

SEQ ID NO: 440971 - DNA, 682 bp, Homo sapiens
  misc_feature: GZ8MTXP02GLAEE.10.88.H11.1.454.CMB.2.raw
  modified_base (594)..(594): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtgggctgaggtgaagagcccgtggggcctgagtgaagtatctcctgcgaggtcttcgtggttacctacctttaacacctatggcatctcgtgggtcgcgacgacggccccgtaggacaaggtcgttggaggttggggttggggttgggtcaggtccgtaccgttaaccgtaaaggttcggaccttaaacgaactaaaattgtacgacaacgtaaggtaacggttaccgaggggtaaccaaggaaccgttaccaaccctaagtaccgaaacccaacgaacgaaccaactaactacccgaacgacgaccaacgacgacctacacgtacggaacgtaggaacggacgaccgtaggacgtacgtacgtacggaccgaacgtaccggtaccgttattacgtttacgnggtaccgacggtaaagaacggtaaacgtaaaaggtcggtaacggtaagggtacggtaacgggggactacgacgtacgacgtaccgggg

SEQ ID NO: 440972 - DNA, 758 bp, Homo sapiens
  misc_feature: GZ8MTXP02HX15Y.10.88.H11.1.454.CMB.2.raw
  modified_base (295)..(295): a, c, t, g, unknown or other
  modified_base (421)..(421): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgaggtgaagatctctggcgaggtctttcgtggttacctaccgtttaacacctagtggcatcctcgtgggtncgacgaccggcccctaggaacgaaggtcgtttggaggtggggtaggggtggtcgaggtcgtacgttacgtaaggttcggactacgaactaaatttagacgtacaacgaagtaacgttcgagggtanaagtacgtacccaaacctataccggaacccaaacgacggaaaccaaccaacgtacccgaacggaacgaaccaacgaacggtaccctaactaacgtaacggtaaaccggtagggtaacgggtaacgacccggtaggaacgtacgttaccgtaacgaaaccggacccgtaaaccgggtaccgttaacgtttaacgtttccgacgggtaccgaaaccggtaaagggtaaaccggtaaaacgggttaaaacggtacggtaacggggtttaaccggggttaaaccgggggtaccggggggtaaacctaacggtacgtaccgggttaaccggaaccccggggg

SEQ ID NO: 440973 - DNA, 586 bp, Homo sapiens
  misc_feature: GZ8MTXP02GIGDF.10.88.H11.1.454.CMB.2.raw
  modified_base (361)..(361): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacacggcccctggacaaggcttggaggtggggtggggtggtcaggcgtcttaccgaaggttggactacactaaattngacacagaacgttcagggacagagtacaccatacgaccacagacacacaccacgagacacacgcctacataggaactagaggtagcgtagagatcgtagacgaacgacggtaccgtattactttacgtacgcggacgaagaacggaaacggttaaaaggtggtaacggtaagggttaacggttaccggggggtaacgaaccgtagtacggaacggtaacccgggg

SEQ ID NO: 440974 - DNA, 681 bp, Homo sapiens
  misc_feature: GZ8MTXP02JWBI3.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctggaggtgaagcgcccgtggggcctcgagtgaagatctcctgcgaggtcttcgtgttacctaacctttaacaccgttatggctatccgtccgtggggtgccgacaccgggcccctaggaacaaggtcttggaggtgggggtgggtggtacaggccgtacttacgaaggttggacctaaacgaactaaaacttgacgactaacgtaggtaaacgttccgagggtaaccaggtactccgaaccgtataccggaccaaacgaacgaaccacacgacccgaacgacgaccaaccgacgacctaacacgtaggaacgagggagtacgaccgtagacgtacgttcgacggaaccgtaacggaccggttacgttaacgttacgtttcccggaggtcccggaacgaggaacggttaaacgggaaaagttcggtaacggggtaaggttaccggggttaccggggacaccgtacggacgtaaccggtacccgggg

SEQ ID NO: 440975 - DNA, 641 bp, Homo sapiens
  misc_feature: GZ8MTXP02HH0G4.10.88.H11.1.454.CMB.2.raw
  modified_base (290)..(290): a, c, t, g, unknown or other
  modified_base (363)..(363): a, c, t, g, unknown or other
  modified_base (415)..(415): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagtccgtggggcctcaggtgaagatctcctgcgaggtcttcgtggttaccacctttaacacctatggctatctccgtgggtncgacacggcccctggacaaggcttggaggtggggtggggtggtcaggcgtcttacgagttgctacacaaattntgacacagaagttcagggtacaggtagtccacctatcgaacccacagaccanactaccacgagcacacgcctaacagtaggaaactggaggtcgaccgtagggaagacttacggtacgaaccggtaacaaccgggtaccgttaagttacgtttacgtacggaccggaccggaaagggtaaacggtaaaccggttaaaaagggtcggtaacgggttaacggggttaacgggttacccggggggaactaaccggtacgtacggaacccgtaacccggggg

SEQ ID NO: 440976 - DNA, 575 bp, Homo sapiens
  misc_feature: GZ8MTXP02IV44E.10.88.H11.1.454.CMB.2.raw
  modified_base (353)..(353): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtggtgcgacacggcccctggacaaggcttgaggtgggtggggtggtcaggcgcttaccgagttgctacacaaattangcacgagtaacgttccaggtacaggagtcaccatcgaccacagacacgaactccaacgacgacacaacgaccctacagtaggaaacttaggacggacgaccgtagacgatcgtacgacgacgacggccgtatacgtttcgtcgacgacgaagacgtaaccggtaaaagtcggacggtaaggtacggttaccgggggtacacgtacgtacgaaccgtaccggg

SEQ ID NO: 440977 - DNA, 583 bp, Homo sapiens
  misc_feature: GZ8MTXP02H8XB8.10.88.H11.1.454.CMB.2.raw
  modified_base (211)..(211): a, c, t, g, unknown or other
  modified_base (233)..(233): a, c, t, g, unknown or other
  modified_base (286)..(286): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacgaggtgcccactcccaggttcagctggtgcagtcgtggggctggaggtgaagngcccgtggggcctgagtgaagntctctgcgaggcttcgtggttacacctttaacacctatgcatctccgtgggtncgacacggcccctaggacaaggcttggaggtggggtggggtggtcaggccgtacgttaaccgaaggttcggactaacaacgtaaattagcgacaacaggtaacgttcgagacgagagtcaaccatacgaaccacacgacacacaccgaacgacgacaacgacgacctacgagtaggaaacgtaggaaggacgacgtagaagatcgagaccgacgacgtaccgtatacttcgcgcgacgaagacgtaaacgtaaagtcggacgtggtacggtacggggacacgacgacgacgaccggg

SEQ ID NO: 440978 - DNA, 831 bp, Homo sapiens
  misc_feature: GZ8MTXP02IRR7N.10.88.H11.1.454.CMB.2.raw
  modified_base (291)..(291): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagcccgtgggcctcgagtgaagattctccgtgcgaggtcttctaggttacctacctttaacacctagtggcactctcgtgggtncgacgacggcccctaggacaaggcgtttaggaggttgggggtacggggtggtcgacggtcccggtacgttaaccgtaagggtttcggaccttaaacgaaccttaaaagttttacgtacgggacctaaacgtaaacggtaaaccggtttaccccggagggggtaaacctaacgggtaaacggtttaccccaacccgaaaagtttacccgggaaaaccccgaaaccgaaacggtaaacccaaaccgtaaccgttaacccgaaaccgggaaacggaccctaaaccgaaccggtaaccccttaaaccgaccggttaaacgggaaaaccggttacgggaaacgggggtaccgaccccggtaaggtaaccggtaccgttacgtaccggaccgggtaacccggtacgggtaacccgttaatttaacgtttccggttacggtccggtaaacggaaaggtaacggtaaacgggttaaaaggtacggtaaacggttaacggggttacgggtaaccgggggaacacggtacgtaccggaacgtacccgggg

SEQ ID NO: 440979 - DNA, 642 bp, Homo sapiens
  misc_feature: GZ8MTXP02I6FGH.10.88.H11.1.454.CMB.2.raw
  modified_base (285)..(285): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttaccacctttaacacctagtggcatctccgtgggtcnccacgacggcccctggacaaggcttggaggtggggtggggtggtcagccgtcttaaccgaaggttcgacctaacgaactaaattatcgacaacgagtaacgttccagggacaggactaccaaccagtacgaaccaacagaccacactaccacgacgacacacgacccgtaactacgtacggaaacgtaggaacgggacgccgtagaagtaactcgtacggaccgaacgaccgggtaccgttacgttaactttccgtacgcggtaccggaaggtaaacggtaaacgtaaaacggtcggtaacgggttaacggtacgggttaccgggggaactacgtacgtacggaaccgtaacccggg

SEQ ID NO: 440980 - DNA, 650 bp, Homo sapiens
  misc_feature: GZ8MTXP02H86I5.10.88.H11.1.454.CMB.2.raw
  modified_base (208)..(208): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagngcccgtggggcctcgagtgaagatctccgtgcgaggtcttcgtggttaactacctttaacacctatcggctatctccgtgggtcgccgacgcggcccctaggacgaggtacttggaggtggggtggttggtcagcgtcgttaaccgagtttcgactaacacgtaaattagcgacaacgagtaacgttccgaggggacaaggtacgtaccaaccgtagtaccgaaaccctacagaccgaacactacccgacgagacctaacacgtccctaacgagtacggaactaggaacggtacgccgtaggacgtactacgtacggaacgacgaccggtacgttaacgtacgtttcgtcggacgacggtaagaaacggtaacggtaaaacggtcggtaacgggttaacggtacggtacccgggggactacgacgtacgaacggtacccggg

SEQ ID NO: 440981 - DNA, 590 bp, Homo sapiens
  misc_feature: GZ8MTXP02FOH0Q.10.88.H11.1.454.CMB.2.raw
  modified_base (332)..(332): a, c, t, g, unknown or other
  modified_base (357)..(357): a, c, t, g, unknown or other
  modified_base (362)..(362): a, c, t, g, unknown or other
  modified_base (432)..(432): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagccctggggcctcagtgaagatctcctgcggaggtcttctggttacaccttaacacctatggctatctccgtggggtcgacgacgacggcccctaggacaagggacttggaggtggggtggggnggtcagcgctacgagttgactacanaattngcacagattcaggacaggagtcaacatcgaacacagaacacactaccacgacgaccacacgaccaacganaggaactaggaggacgacgtaggagactacgtacgacgacgaccggacgtattacttcgtacggacgacggaacggaacggtaaacggtaaaagtacggtaacgggttaaggttacgggttaccgggggaactacggtacgtacggaacgtacccggg

SEQ ID NO: 440982 - DNA, 566 bp, Homo sapiens
  misc_feature: GZ8MTXP02F39R5.10.88.H11.1.454.CMB.2.raw
  modified_base (207)..(207): a, c, t, g, unknown or other
  modified_base (230)..(230): a, c, t, g, unknown or other
  modified_base (286)..(286): a, c, t, g, unknown or other
  modified_base (332)..(332): a, c, t, g, unknown or other
  modified_base (348)..(348): a, c, t, g, unknown or other
  modified_base (356)..(356): a, c, t, g, unknown or other
  modified_base (361)..(361): a, c, t, g, unknown or other
  modified_base (378)..(378): a, c, t, g, unknown or other
  modified_base (490)..(490): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngcccgtggggcctcgagtgaagntctcctgcgaggtcttctggttacctacctttaacacctatggcatctcctgggtncgacacggcccctggacaggcttgaggtggggtgggtggtcagcgnttaccagttgctacanaaacttangacanagagttccgaggacagngtaccaccatgaaccacagaacacaactccacgagcaacacgacctacagtacggaacgtgacggacgccgtaggagactcacgacgacgaccggtaccgtattaactttcncggtacgacgtagacgtaacgtaaaacgtgacggttaaggtacggttacgggggacacgtacgtcgacgtaccggg

SEQ ID NO: 440983 - DNA, 681 bp, Homo sapiens
  misc_feature: GZ8MTXP02ISU99.10.88.H11.1.454.CMB.2.raw
  modified_base (510)..(510): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtgggctgaggtgaagagcccgtggggcctcgagtgaagatctccgtgcgagtcttcgtaggttacctacctttaacacctagtgcatcgtcgtggtcgcgacgacggcccctaggacgtaaggacgtttggacggtggggtaggggtggtcaggccgttacgttaaccgtaaggttcgacctaacgaactaaaattcgtagactaaacgaagtaacgttccgaacggggtacaaggtaacgtacccgaacctaagtcgaaacccaaacgaacggaaacactaacgtacccgaaacgacgaccaacgaaccgaccgaanacggtaacgaaaccgtaggaacggtacgaccgtagaagactacgacggaccgacgacggtcttatactttacgcgacggtacgaacgtaacggtaaaccgtaaaaggttcggtaacgggtaacggttaacgggggtacccggggacaacgacgtacggaaccgtaccgggg

SEQ ID NO: 440984 - DNA, 549 bp, Homo sapiens
  misc_feature: GZ8MTXP02JVVB1.10.88.H11.1.454.CMB.2.raw
  modified_base (209)..(209): a, c, t, g, unknown or other
  modified_base (370)..(370): a, c, t, g, unknown or other
  modified_base (378)..(378): a, c, t, g, unknown or other
  modified_base (400)..(400): a, c, t, g, unknown or other
  modified_base (410)..(410): a, c, t, g, unknown or other
  modified_base (417)..(417): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagngcccgtggggcctcagtgaagatctcctgcgaggtcttctggttacacctttaacacctatggcatctccgtgggtcgcgacgacggcccctagggacaaggacttggaggtggggtggggtggtcagcgtcttacgaagttggctacgacaattatgcanagagttcnggacagcgtcaccatcgaccanacgtacacanccacganacacacgctacataggacagagagctagagattcgagacgacgaccggtcgtatactttcgcgcggacgagaagaaccgtaaaaggcgtacggtaaggtacggtacgggggactacgagtacgacgaccggg

SEQ ID NO: 440985 - DNA, 705 bp, Homo sapiens
  misc_feature: GZ8MTXP02GGVIN.10.88.H11.1.454.CMB.2.raw
  modified_base (185)..(185): a, c, t, g, unknown or other
  modified_base (290)..(290): a, c, t, g, unknown or other
  modified_base (361)..(361): a, c, t, g, unknown or other
  modified_base (370)..(370): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtncagtctgggctggaggtgaagagccctggggcctcgagtgaagatctccgtgcgaggtcttcgtggttaacctacctttaacaccttagtggcatctcgtgggtncgacgcggcccctaggacaaggacttggaggtggggtggggtggtcaggcgtactacgtaagttgactaanactaaattntagacacgaagtaacgttcgaggacagacgtaccaaccagtacgaccaaagagaaacctacaactaccgaacggaacaccaaacaaccgtacctaaaccagttaacgggtaaaccgtagggaaacgggaccgtacccgtagggaaaccttacgttacgtaccggaaccgaaaccggtaccgggtacccgtttaatttccgtttaccggacggtaccgggaacggaaaggtaacgggtaaaacggttaaaagggtcgtaacggggttaacggggtttaacgggggttaacccgggggacctaacggtacgttaccggggtaaccgtaacccggggg

SEQ ID NO: 440986 - DNA, 646 bp, Homo sapiens
  misc_feature: GZ8MTXP02HB8SE.10.88.H11.1.454.CMB.2.raw
  modified_base (233)..(233): a, c, t, g, unknown or other
  modified_base (383)..(383): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagntctcctgcgaggtcttgtggttactaccgtttaacacctagtcggcagtctccgtgggtcgcgacgacggcccctaggaaccaaggtcttggaggttggggtggggtggtcaggtccgtacttacgaaggttcggactacaactaaattncgacaacgaaggtaacgttccgagggacagacgtccaacagtcgaaaccacgagacaacactaccgaacgacgacacgacgacctacgtagtaggtaacgtaggacggacgaccgaggaacgtacgtacgtagaaccggaacgaccggtaccgttattaacgtttcgtacggtcgacggtaaaggaacgtaaacggtaaaacggtcggtaacgggttaaggtacgggttaccgggggacacgtacgtacggacggtaaccggg

SEQ ID NO: 440987 - DNA, 683 bp, Homo sapiens
  misc_feature: GZ8MTXP02H6GUK.10.88.H11.1.454.CMB.2.raw
  modified_base (223)..(223): a, c, t, g, unknown or other
  modified_base (379)..(379): a, c, t, g, unknown or other
tcagcatagtagtgcacgaccggtgctcgatttagcgacagcgagaacacacaaaggggacccaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctnagtgaagatctctgcgaggtcttctggttacacctttaacacctatggcatctccgtgggtgcgacacggccccgtaggaacaaggtcgttggaggtggggtggggtggtcgaggcgtaccgttaaccgaaggttggactaacaactaaaatttangacaacgagtaacgttcaggacagacgtacaccagtacgaccaacacgaacacaactacccgaacgacgaccaacgacgtaccctaacaacgtacgggaaacgtggaaggacgacctaggaagactacgacggaaccgtaaaccggaccgggtaccgttaacttaacgtttcccgtaggaccggaacggtaaagggaaacggtaaaaccggttaaaaacggtggtaaccggttaacggggttaaccggggttacccggggggaaactaaccggtaaacggtaccggaaaaccggtacccggggg

SEQ ID NO: 440988 - DNA, 544 bp, Homo sapiens
  misc_feature: GZ8MTXP02GVVKG.10.88.H11.1.454.CMB.2.raw
  modified_base (284)..(284): a, c, t, g, unknown or other
  modified_base (367)..(367): a, c, t, g, unknown or other
  modified_base (398)..(399): a, c, t, g, unknown or other
  modified_base (439)..(439): a, c, t, g, unknown or other
  modified_base (445)..(445): a, c, t, g, unknown or other
  modified_base (451)..(451): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctgggggcctcagtgaagatctcctgcgaggcttctggttacacctttaacacctatggcatctccgtgggtncgacacggcccctggacaaggcttgaggtggggtggggtggtcagcgtacttaaccgaaggttggcctaacaacaaaatttangacaacagaagttccaggacagagtcaccannaccacagacacatcacgagcacacgacctacataggaacngagganctaganatcacgacgacgacgacgtattacttcgtgcgacgagaacgtaacgtaaagtgacggtaaggtacggtacggggacacgacgtacgacgtacg

SEQ ID NO: 440989 - DNA, 580 bp, Homo sapiens
  misc_feature: GZ8MTXP02H305S.10.88.H11.1.454.CMB.2.raw
  modified_base (285)..(285): a, c, t, g, unknown or other
  modified_base (444)..(444): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctgggctgaggtgaagagcccgtggggcctcagtgaagatctcctgcgaggctttcgtggttacacctttaacacctatggcatctccgtggggtcncgacgacggcccctaggacgaaggacgttggaggtggggtggggtggtcaggcgtacttacgaaggtcggactacaataaattatgcacaagtagttccgaggacagagtccaacagtacgaccacagacacactaccagacgacacacgacctacaanggaactaggaggtacgaccgagagatacgtacgacgacgaccggtacgtatacgtttcgtacgtcgacgaggaaggaacgtaaaagtgacggttggtacggtaccgggggacacgtacggtacgtacgtacccggg

SEQ ID NO: 440990 - DNA, 720 bp, Homo sapiens
  misc_feature: GZ8MTXP02IO215.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgccccgtggggcctcgagtgaagatctcctgcgaggcttctggttacacctttaacacctatggcactcctccgtgggtcgccgacgacggccccctagggaacaaggtacgtttggaggttcgggggtgggggtcgggtacgacggcgtaccgttaaccgaaaggtttcggacttaaacaaacgtaaaactttagtcgaccaataaggtaaacgtttcccgaggggaaccaagggtaacgtaccaaaccctagtacgaaacccaaacaagaaccaacaactacccaacggaacaccaaccgacgacctaacgagtacggaaaccgtaggaacgggagacccgtaggaagacgttacgacgaacgaacgtaccggtaccgttaagttacgtttacgtggtaccggaccggtaaaggaaacggtaaacgttaaaaacggtaggtaaaccggttaagggttaaccgggttaccgggggaaacctacgtaacgtacggtaaccgaacccgggg

SEQ ID NO: 440991 - DNA, 523 bp, Homo sapiens
  misc_feature: GZ8MTXP02FN4CY.10.88.H11.1.454.CMB.2.raw
  modified_base (351)..(351): a, c, t, g, unknown or other
  modified_base (490)..(490): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacacggcccctggacaaggcttgagtggggtggggtggtcagcgcttacaagttgctacacaattangcacagaacgttccagggacagagtcaccatcgaaccacagacacactccacgacgcacacgacctacataggaactaggaggagcctagagatctagacgacgacggacgtatattctgcgacgagacgacgtaaagngacgtggtacgtacgggggacagatcgacacgg

SEQ ID NO: 440992 - DNA, 654 bp, Homo sapiens
  misc_feature: GZ8MTXP02FRCYK.10.88.H11.1.454.CMB.2.raw
  modified_base (229)..(229): a, c, t, g, unknown or other
  modified_base (285)..(285): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagccctggggcctgagtgaagntctcctgcgaggtcttcgtggttacacctttaacacctatggcatctccgtgggtncgacacggcccctggacaaggcttggaggtggggtggggtggtcaggccgtacttaccgaaggttcggactacgtaactaaattagtgacaaacgaggtaaacgtttcccgaggggacaacgggtaactacccaaccgtaataccgaaacccgaaacaacgaaaccaccaactacccgaaacgacgaccaacgaacgaccctaacagtacggaaacgtaggaggacgccgtagaggactacgtacggaaccgaacgaccggtaccgtattaacgtttccaggacgacggaacggaaaggtaaaccgtaaaaggtcgtaacggtcgggtaacggttaccgggggacaccgtagacgaaccgtaaccgggg

SEQ ID NO: 440993 - DNA, 635 bp, Homo sapiens
  misc_feature: GZ8MTXP02I0ZCP.10.88.H11.1.454.CMB.2.raw
  modified_base (210)..(210): a, c, t, g, unknown or other
  modified_base (232)..(232): a, c, t, g, unknown or other
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtctggggctggaggtgaagngcccgtgggcctcgagtgaagntctcctgcgaggtcttcgtggttacctacctttaacacctagtcggcattctccgtgggtcgcgacgacggcccctaggacaaggtacttggaggtggggtggggtggtcagcgtcttaccgagttcgctaacacaaattntgacacagtaacgttccgaggacagacgtccacctatacgaccacacgacacactccaacgacgacacacgacctacagtacggaactggacggacgaccgtagaacgactcgtacggacgaaccgtaccggtaccgtacttactttcgtcggaccgtacggaacggaacggtaaacggttaaaacggtacggtaacgggttaacgggttacggggttaaccgggggtaacaacggtacggtacggaaccggtaacccgggg

SEQ ID NO: 440994 - DNA, 534 bp, Homo sapiens
  misc_feature: GZ8MTXP02FJ6RE.10.88.H11.1.454.CMB.2.raw
  modified_base (281)..(281): a, c, t, g, unknown or other
  modified_base (346)..(346): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtggtcagcgctacaagttgctacacaaattngacacagaagttccagggacagagtccaaccatcgaaccacacgacacactccaacgagcaacacgcctacataggaactgaggagcctagaagactcgtagacgacgacgaccgtatacttctgcgcgagacgtaacgtaaaagtgacgtaaggtacgttacgggggacacgagtacgacgaaccgg

SEQ ID NO: 440995 - DNA, 611 bp, Homo sapiens
  misc_feature: GZ8MTXP02JTCV9.10.88.H11.1.454.CMB.2.raw
  modified_base (230)..(230): a, c, t, g, unknown or other
  modified_base (286)..(286): a, c, t, g, unknown or other
  modified_base (370)..(370): a, c, t, g, unknown or other
  modified_base (527)..(527): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagntctcctgcgaggcttcgtggttaccacctttaacacctatggcatctccgtgggtncgacgacggcccctaggacaaggcttggaggtggggtggggtggtcaggccgtacttaccgagttcggactaacaactaaattntgacaacgtagtaacggttccgagggtacaggacgtaccacctatacgaacccaacacgaaccacactacccagacaccaacgacgacctacgagtacggactaggacggtacgccgtagagactcgacggacgaccgacggtacgtatactttcgngtcggacgagaacgtaaacgtaaggtcgtacggttaacgggtacgggttaccgggggaacacgtacggacgaccggtaccgggg

SEQ ID NO: 440996 - DNA, 673 bp, Homo sapiens
  misc_feature: GZ8MTXP02F58F0.10.88.H11.1.454.CMB.2.raw
  modified_base (210)..(210): a, c, t, g, unknown or other
  modified_base (231)..(231): a, c, t, g, unknown or other
  modified_base (294)..(294): a, c, t, g, unknown or other
  modified_base (321)..(321): a, c, t, g, unknown or other
  modified_base (378)..(378): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcattccttttcttggtggcagcagcaacaggtcgcccactcccaggttcagctggtgcagtcgtggggctggaggtgaagngcccgtgggcctcagtgaagntctcctgcgaggtcttcgtaggttaacctacctttaacaccttagtggctatctccgtgggtncgacgcggcccctggacaagcttaggnggtggggtgggtggtcgaggtccgcttaccgaggttcgactaacgtaattaaagttntgtacacgaagtacgttaccgaggacagagtaccacagtacgaccaacacgaacacaactaccgaacgacgaccaacgacgacctacgtacgtacggtaacgaggacggacgacgtaggaagtactacgtacgaaccgaacgaaccggtaccggtaatttacgttacgttacgggacggtacggaaagtaaacggtaaacggttaaaacggtagggttaacgggttaacggggtttaaccggggttacccggggggaactaacggtaacggttaccggaacccggtaacccgggg

SEQ ID NO: 440997 - DNA, 618 bp, Homo sapiens
  misc_feature: GZ8MTXP02I2KKZ.10.88.H11.1.454.CMB.2.raw
  modified_base (318)..(318): a, c, t, g, unknown or other
tcagcatagtagtgcacgaccggtgctcgatttagcgacagcgagaacacacaaagggacccaaaaaccacacccctccttgggagaatccctagatcacagctcctcaccatggactggacctggagcattcctttttcttggtggcagcagcaacaggtcgcccactcccaggttcagctggtgcagtcgtgggctgagtgagagccgcggcgtcagtgagatctcctgcgacgcttctgttactaccttaactactatgcatctcgtggtgcacgacggcccgtgagacgacgttgaggtgggtggggtaggtcngcgtcttaccgtaagtcgtcacgtacaaacttatgacacgtaagtaacgttcccgagggacacgagtaccaccgaatcgaacacagacacactaccacgacgcaacacgacctacgactagacgtacgacggagccgtacgacgagttacgcgtaacgaacgacggtaccgtagttactttacgtacggtcgaccggaaggtaacggtaaacggttaaaaacggtcggtaacgggtttaacgggttaacggggtttacccgggggaacggtaacgtacgacggttaaccgtaacccgggg

SEQ ID NO: 440998 - DNA, 674 bp, Homo sapiens
  misc_feature: GZ8MTXP02JD20X.10.88.H11.1.454.CMB.2.raw
tcagcatagtagtgcacgaccggtgctcgatttagcgacagcgagaacacacaaaggggacccaaaaaccacaccctccttgggagaatcccctagatcacagctcctcaccatggactggacctggagcattccttttcttggtggcagcagcaacaggtgcccactcccaggttcagctggtgcagtctggggctgaggtgaagacgcccgtggggcctcgagtggaagtactctccgtgcgaggtcttcgtaggttacctacctttaacacctatcggcatctccgtgggtcgcgacgcggccctaggacaaggcttggagggtggggtggggtggtcaggcgtacgttaccgaagttcgactaacgaactaaactttgcgtacaacgtaggtaaccgttaccgagggacaggactacccacatacggaaccacacgacacgactacccagacaccaacacgacctacacgtacggaacgtaggacggtacgaccgtaggaacgtacgttacgacggaaccgaccggtaacggtaccgttaacgttacgttccgtcggtacggaaccggaaaggtaacggtaaaacggttaaaacggtacgggtaacgggttaacgggttacccgggtaaccgggggtacaaccggtacgtaccggaccgtaacccggggg

SEQ ID NO: 440999 - DNA, 724 bp, Homo sapiens
  misc_feature: GZ8MTXP02H28UP.10.88.H11.1.454.CMB.2.raw
  modified_base (263)..(263): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtgcccactcccaggttcagctggtgcagtcgtgggctggaggtgaagagcccgtggggcctcgagtgaagatctcctgcgaggcttctggttacacctttaacncctatcggcattctccgtgggtgcgacgcggcccctaggacaaggtcttggaggtggggtggggtggtcgaggtcgtacttaaccgaaggttcggactaacgaactaaagttagtacgacaacgtaaggtaaacgttacccgagggtaacaaggtaacgttaccgaacctaagtaccgaaacccgaaacaacgaaccaacgtaactacccgaaacgacgaccgaacgaacgtacctacgaagtacgggaaaccgtgggaaggtacgtaccgtaggacgtaacgtacggtacggaaccggaacggtacccgggtaccgttaacgttacgttttacggacggtacggtaccggaaaggtaaacggtaaacggttaaaaggttacggtaacgggtttaacgggggttaacgggttaacccggggggaactaacggtaacggttaccggaaaccggtacccgggg

SEQ ID NO: 441000 - DNA, 602 bp, Homo sapiens
  misc_feature: GZ8MTXP02F7UZW.10.88.H11.1.454.CMB.2.raw
  modified_base (220)..(220): a, c, t, g, unknown or other
  modified_base (228)..(228): a, c, t, g, unknown or other
  modified_base (286)..(286): a, c, t, g, unknown or other
  modified_base (372)..(372): a, c, t, g, unknown or other
  modified_base (412)..(412): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattccttttcttggtggcagcagcaacaggtgcccactcccaggttcagctggtgcagtctggggctgaggtgaagagcccgtggggcctnagtgaagntctcctgcgaggtattcgtggttacctacctttaacacctagtgcatctccgtgggtncgacgacggccctaggacaaggtcttggaggtggggtggggtggtcacggtcgctttaaccgaaggttcggactaacactaaattngacacagtaacgttcgaggacagagtcaacatacgaccanacgacacactaccaacgacgacacgacgacctaacacgtaggaactggaggacgccgtagagacttcgagaacgacgaacggtccgttattacgtttcgacggacgtacggaaagtacggtaaaggtaaaacgtggtaacggtcggtaacgggttaccgggggactaaccgaggtacgaccggtaccggg

SEQ ID NO: 441001 - DNA, 708 bp, Homo sapiens
  misc_feature: GZ8MTXP02GDGCK.10.88.H11.1.454.CMB.2.raw
  modified_base (222)..(222): a, c, t, g, unknown or other
  modified_base (230)..(230): a, c, t, g, unknown or other
  modified_base (236)..(236): a, c, t, g, unknown or other
  modified_base (268)..(268): a, c, t, g, unknown or other
  modified_base (283)..(283): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtgggctggaggtgaagcgcccgtgggcctnagtgaagntctcgngcgaggtcttcgtgttacctaccttacactangctatcgtcgtgggncgacgaccggcctaggacaaggtcgtggaggtgggggtgggtggtacgacggtcgtacgttaacgtaaggttcgactaaaccgtaataaacgtttgacggacaacgtaggtaacttaccgagggtaccaggtaacctaccgaacaacgtacgaaacccaacgtaaccgacaaaccgactaacccgaggaaccaccaaccggacctaacccgtaagaaacgggtacggtaaacgtagggaacgggtacgtaccgaggtaacgtaaccgttcggaacggaaccggtaccgtaaccgggttactttaaaggtttccgttaacggcggtaaccggtaaggaaaacgtaaacgggtaaaccggttaaaaggcggttaacgggtaacgggttaacgggtacgggaactagacggtccgacgggtaccgggg

SEQ ID NO: 441002 - DNA, 630 bp, Homo sapiens
  misc_feature: GZ8MTXP02HUPKF.10.88.H11.1.454.CMB.2.raw
  modified_base (374)..(374): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctcctgcgaggctttcgtggttactacctttaacacctatggcatctccgtgggtcgcgacacggcccctaggacaaggcttggaggtggggtagggtggtcagcgacgtttaccgaggttggactacgaactaaattangacaacgagtaaacgttccgaggtacaagtacgtaccaaccagtcaaacccgaacaacgaacaacactaccaacgacgacctaacgaacgacctaacgacgtacggaaacgtaggaacgggacgtccgtaggacgacttacgacgacgaacgacggtccgttaattactttcgagtcgacgtaaggaacgtaacgtaaaagtaggacggttaagggtacggttaccgggggacacgtacgtacgaaccgtaccggg

SEQ ID NO: 441003 - DNA, 616 bp, Homo sapiens
  misc_feature: GZ8MTXP02F5EVD.10.88.H11.1.454.CMB.2.raw
  modified_base (222)..(222): a, c, t, g, unknown or other
  modified_base (230)..(230): a, c, t, g, unknown or other
  modified_base (235)..(235): a, c, t, g, unknown or other
  modified_base (239)..(239): a, c, t, g, unknown or other
  modified_base (261)..(261): a, c, t, g, unknown or other
  modified_base (274)..(274): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctgaggtgaagcgccgtgggcctnagtgaagntctcngcgngtcttgtgtactacttacactngcatctcgtggcncgaccgcggtcccctaggaccgaaaggtcgttggagggttgggggtggggtaggtcgaggccgttacgttaaccgtaggttcgactaacaactaattgacgactacaaggtaacgttcgaggtacacggtacgtaccaaccagtaccaccaaacacgaacaacgacacccgaacgacactaacaccgactaacacgtacgggaaactgggaaacgcgccgtagaacgctacgagaccgaacgtacggacttagttacttcgcggacgaggtaaacgaagaaacggttaaacgcggtaacggtaaggttaccggacggggtacacgtagccgaacgtcccggg

SEQ ID NO: 441004 - DNA, 710 bp, Homo sapiens
  misc_feature: GZ8MTXP02HXBCW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagcgcccgtggggcctcgagtgaagatctcctgcgaggtcttcgtggttaacctacctttaacaccttagtcggcacttcgtccgtggggtcgccgacgaccggtccccgtaggaaccgtaaggtacgttggagggttgggggtaggggtcggtacaggtcgtactttaacgaaggttcggaacctaaacgaactaaacgttgtacgactaacgaagtaaccggttacgaggggtacaaggtaacgtcccaaccagtaccgaaacccaacgaacgaaccaacgactacccgaacgacgaccaacgacgacctacgtagtacggaaaccgtggaacggacgtaccgtagacgtacgttacgacggaaccgaaccgtaaccggtccgttaagttactttacgacggtaccggaacggaacggtaaacgaaacgggtaaacgtcggaacgggttaaggttaccgggttaccgggggaacacgtaacgtacgtaaccggtaccgggg

SEQ ID NO: 441005 - DNA, 650 bp, Homo sapiens
  misc_feature: GZ8MTXP02JRMG6.10.88.H11.1.454.CMB.2.raw
  modified_base (210)..(210): a, c, t, g, unknown or other
  modified_base (278)..(278): a, c, t, g, unknown or other
  modified_base (285)..(285): a, c, t, g, unknown or other
  modified_base (520)..(520): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagngcccgtggggcctcgagtgaagatctccgtgcgaggtcttcgtggttacaccttaacacctatcggcntctccgngggtcgcgacgacggcccctaggacaaggtcgttggaggtggggtggggtggcgaggccgtacttaccgaaggttcggacctactaaactaaatttagtagacgaacgtagtaaacgttccgaggggtacaaacggtacgtaccaaccgtagtacggaacccaacaacgaacaacaacgacccaacggacgaccaacgacgaccctaacgacgttacgaacgtaggaacgggacnccgagagacgtacgacggacgacgtacggactagtacttcgagcgtacggagaacggaaacgtaaaggtcggtaacggtaacgggtaacgggttaccgggggactacggtacgaccggacgtaaccgggg

SEQ ID NO: 441006 - DNA, 621 bp, Homo sapiens
  misc_feature: GZ8MTXP02IRG0R.10.88.H11.1.454.CMB.2.raw
  modified_base (384)..(384): a, c, t, g, unknown or other
  modified_base (391)..(391): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtctggggctggaggtgaagagcccgtggggcctcgagtgaagatctccgtggcgaggtctttcgtggttaacctacctttaacacctagtcggcattcctccgtgggtcgcgacgcggccccgtaggacaaggtcttggaggtggggtggggtggtcaggcgtacgttacgaggttcgactaacaactaaattancgactanaagtacgttcagggacagacgtacaacctagacgaaccacagaacacactaccgacgacgacaacacgacctacgaagtacggaaactggaggacgcgtagagtacgtgacggaacgacgtacggaccttagttactttcggtacgccggagaaggtaaacgtaacggtaaaagtcggtaacggttaagggtacgggtaccgggggacacgacgtcggaacgtaccgggg

SEQ ID NO: 441007 - DNA, 695 bp, Homo sapiens
  misc_feature: GZ8MTXP02IJWJN.10.88.H11.1.454.CMB.2.raw
  modified_base (218)..(218): a, c, t, g, unknown or other
  modified_base (226)..(226): a, c, t, g, unknown or other
  modified_base (335)..(335): a, c, t, g, unknown or other
  modified_base (464)..(464): a, c, t, g, unknown or other
  modified_base (482)..(482): a, c, t, g, unknown or other
tcagcatagtagtgcacgaccggtgctcgatttagcgacagcgagaacacacaaagggacccaaaaccacacccctccttgggagaatcccctagatcacagctcctcaccatggactggacctggagcattccttttctggtggcagcagcaacaggtgcccactcccaggttcagctggtgcagtcgtgggctggaggtgaagcgccctgggcctnagtgaagntctctgcgaggcttcgtggttacaccttaacacctagtggcatctccgtgggtcaccgacgcggccccgtaggaccgaaggtcttggaggtgggggtggggtgggtacnggccgtacgttaacgaaggttcggacctaacaacgtaaactttagcgacgaacgtaaggtaacgttccgaggacgaacgaacgtccaacctaagtaccgaaaccacgaacgaactacacaccgaacganacccaacgtacaccctanacgtacgacgtcggaagagcctagggagtaacctcggaacgaaccgaccgtaaccggggtaccgttaaattcgttttacggcggacccggtaacgtaaaagggaaacggtaaaccgggttaaaaacggtcggaaaccggggttaacggggttaaaccggggtaaccccgggggtaaacgtaacggtaccggtaaccggaacccggtaccgggg

SEQ ID NO: 441008 - DNA, 698 bp, Homo sapiens
  misc_feature: GZ8MTXP02FST68.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatctccgtgcgaggtcttcgtggttacctaccttaacacctatggcatctccgtgggtcgcgacgacggcccctaggacgaaggtcgttggaggttgggggtggggtggtcgaggtcgtccttaaccggtaaggtttcggacctaacgaactaaaagttagtcgacaacgtaagtaacgttccgagggactaaggacgtacccaacctagtaccgaaccaacaacgaccaacaccgtaccgacgacgacaactacgacctaacgagtacggaacgtagggaaggacgccgtaggacgtacgttaccgaacggaaccggtaaccgtaccgggtaccgtttaacgttacgttttaccgcggaccggtaacgtaaacggaaacggtaaaacggtaaaaggtcggttaacgggtaacgggttacggggtaccgggggaacaacggtacgtacggaccggtaacccggggg

SEQ ID NO: 441009 - DNA, 556 bp, Homo sapiens
  misc_feature: GZ8MTXP02JR1E2.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgagtgggtggtggtcagcgcttaccgaagttggctacacaaatttntgacacgagacgttcaggacaagagtacaccagtcgaacccacacgacacatccgacgagacacacgcctacataggaactggacggtagctcggagatcacggacgacgaccggtaccgtaatcgtttactcggacgcgaggaacggaacgtaaaaggtggtaacggtggtacggttaccgggggacacgagtcggacaccggg

SEQ ID NO: 441010 - DNA, 709 bp, Homo sapiens
  misc_feature: GZ8MTXP02FKW6L.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatctctgcgaggtcttcgtaggttacctaacctttaacaccttagtggctatctccgtggggtcgacgacgacggccccgtaggacgaaggtcgttggaggtggggtggggtggtcgaggccgtacgttaccgtaagttggactaacaactaaatttagtgactaacgtaacgtaacggttaccgagggaaacaggtaacgttaccaacctaacgtaccgaaacccaacaacgaaacctacgaactcccgaacgacgaccaacgacgacctaacagtacggaaactagggacggacgaccgtaggaagtactacgacggaccgaacggaccggttaccgttaattacgtttcgtacggcggtacggaaacggaaacggtaaaccggttaaaaaggtcggttaaacggggttaacgggttaaaccgggggtttaaccgggggacgtaaacgtaacggtacgacccggtaaaccggggg

SEQ ID NO: 441011 - DNA, 741 bp, Homo sapiens
  misc_feature: GZ8MTXP02I5T7M.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagactctccgtgcgaggtcttcgtacggttacctaccttaacacctagtcggctacttcgtccggtgggtacgccgaaccgaccgggcccctaggaacgtaacggtacgttacgggaggggttgggggttacggggtcggtacgacggtaccgttaccgttaaccggtaaggtttcggacctttaaacgaacgttaaacgtttacgacgactaaacgtaacggtaaccgttaccgagggtaacgaaggtaccgtaccaacgtacgtaccgaaaccaacgacgaaccctaacacgtacccgaacgacaccaaacgtacccgtaacctaacgtacgtaaacggaccgttaagggaccggtacgtaccgtagaaaccgtcgtacgacgaaccggtaccgtagggtaacccttagtttacgttcggacggacgacggtaaggaaacggtaaacgttaaagtcggtaggtaacggtaccgggtacgggactacgacgtacggaaccgtccgggg

SEQ ID NO: 441012 - DNA, 702 bp, Homo sapiens
  misc_feature: GZ8MTXP02GEKNF.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccgaggttcagctggtgcagtcgtggggctggaggtgaagcgcccgtgggcctcgagtgaagatctctgcgaggtcttgtcgttactaccttacactatgcatctcgtggtgcgacacggcccctaggacaagcgttggaggtggggtggggtggtcacggcgtaccgttaaccgtaggtttcggactaacgtaactaaagttactgaacaacgtaggtaaacgttccgaggactaacgaacgtaccaacctataccgaaacccaacgaacgaccaacactaccgacgaaacgccaacgacgacctaacagtaaaggactagggacgacgaccgtagggaatacgtacgacggaccgtaaccggtaccggtaccgtttaagttaacgtttcggtcggaaacggtaccgggaaaaggtaacggttaaaacggttaaaaacgggtccggttaaacgggttaacggggtttaaccggggtaaaccggggggtaacctaacggtaaccggttacggaacccggttaaacccggggg

SEQ ID NO: 441013 - DNA, 620 bp, Homo sapiens
  misc_feature: GZ8MTXP02FGYKP.10.88.H11.1.454.CMB.2.raw
  modified_base (281)..(281): a, c, t, g, unknown or other
  modified_base (352)..(352): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaaggctgagtggggtggggtggtcagcgactaccgaagttgctaacacaaattngcacagaacgttcaggacagagtcacatcgacacagacacataccacgagcacacgcctacataggaactaggacgggacgaccgtaggaagacgtacgtacgaaccggaaccgacccgggtacccgttaattaacgtttaccgttacgaccgggtacggaaagggaacggtaaaaccggttaaaaaggtacggtaacgggttaacggggttaacgggtttacccgggggggaaactaaccgtaaggtaccggaaccgtaacccgggg

SEQ ID NO: 441014 - DNA, 642 bp, Homo sapiens
  misc_feature: GZ8MTXP02HN2PQ.10.88.H11.1.454.CMB.2.raw
  modified_base (221)..(221): a, c, t, g, unknown or other
  modified_base (283)..(283): a, c, t, g, unknown or other
  modified_base (288)..(288): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcattcctttttcttggtggcagcagcaacaggtgcccactcccaggttcagctggtgcagtctggggctgaggtgaagagccgtggggcctnagtgaagatctctgcgaggcttcgtggttactactttaacacctagtgcatctccgtgggtncgacncggcccctaggacaggtcttggaggtggggtggggtggtcagcgtacttaccgaaggttcggactaacactaaaatttagcgacaacgagtaacgttaccaggggtacagtacgtaccaaccatcgaacccaacaacgacaactactaccaacgacgaccacaacgcctacaacgtaggaacgtaggaacgggacgactaggatactacgtacgaacgacggtaccggtacgttattacttttcgacggtcggaacggtaaggaacggtaaacgtaaaacggtggtaacgggttaacgggttaacgggtaccggggggtaacacggtaacgtacggtaaccgtaaccccggggg

SEQ ID NO: 441015 - DNA, 622 bp, Homo sapiens
  misc_feature: GZ8MTXP02JL85R.10.88.H11.1.454.CMB.2.raw
  modified_base (390)..(390): a, c, t, g, unknown or other
  modified_base (502)..(502): a, c, t, g, unknown or other
  modified_base (532)..(532): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttctggttactacctttaacacctatcggcattctccgtgggtcgcgacgtacggcccctggaacaacggtcgtttggacggttgggggtgggggtcgggtcgacggcggtacttaccgaaggtttggacctaacactaaatttancgccaacaggtaacgttccagggtaccaagtacgtacaccagtacgaccaacgtacgaacacaactccgacgacgacacgacacctacacgtagactggagagcgtagacgntcgtacgacgacacgtcgttatactttcgngaccgacgagaaacggtaaacgtaaacggtacggtacggtaacgggtacgggttacccgggggacacgtacgtacggaccgtaacccggg

SEQ ID NO: 441016 - DNA, 844 bp, Homo sapiens
  misc_feature: GZ8MTXP02JEZUU.10.88.H11.1.454.CMB.2.raw
  modified_base (210)..(210): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagngcccgtggggcctgagtgaagatctcgtgcgagtcttcgtgttactaccttaacactagtgctatcgtccgtgggtcgaccgacgccggcccctaggaacgtaaggtcgtttgggaggggttcgggggtgggggtcggtacgacggtccgttaccttaaaccggtaaggttcggacctaaacgtaaactaaaacgtttcacggacctaaacgtaaggtaaccgttaccgaggggaaccaaggtaaccgtaccaaacctagtaccgaaacccgaaacgaacgaaacccaaccgtaaccgtaacccgaaacggaaccgacccgaaaccgaccggtaaccctaaacgtaaggttaaaccgggaaaccgttaaggggaacggggtaacccgtaccggttaagggaaaccgtaacggttacccgtaacgggaaacccggaaccggtaaacccgggttacccgtttaaagtttaaccgttttccgggtacggaacccgggtaacggtaaaacgggtaaaacgggttaaaacccggtaaaaagggtttccggggtaaccggggtttaacgggggttaaccggggtaacccggggggtaaactaacggtacggtaaccggggtaacccgtaaaccccggggg

SEQ ID NO: 441017 - DNA, 641 bp, Homo sapiens
  misc_feature: GZ8MTXP02GU3GX.10.88.H11.1.454.CMB.2.raw
  modified_base (208)..(208): a, c, t, g, unknown or other
  modified_base (236)..(236): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctggaggtgaagngcccgtggggcctcagtgaagatctccngcggaggtcttcgtggttacctacctttaacacctatgcatctcgtgggtgacgacgacggcccgtaggaacaggtacgttggaggtggggtggggtggtcgaggccgtcttaaccgaggttggacctaacgaactaaagttagtcgactaacgtaagaacgttccgagggtacaagacgtacaaccctagtaccgaacaacgacgaacaacactaccgaacgacgaccaacaacgaccgtaacagtaggaaaccgtaggaacggagtcctagagtactcgacgacgaacgaccgtacgtttaatacgtttacgcggtacgaccggaaggaaacgtaaacgttaaaggaacggtacggtaagggtacggttaaccgggggactacgacggtacgaacgtaccggg

SEQ ID NO: 441018 - DNA, 682 bp, Homo sapiens
  misc_feature: GZ8MTXP02GV64U.10.88.H11.1.454.CMB.2.raw
  modified_base (289)..(289): a, c, t, g, unknown or other
  modified_base (294)..(294): a, c, t, g, unknown or other
  modified_base (366)..(366): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctccgtgcgaggtcttcgtggttaccacctttaacacctatggcatctccgtgggtcncgacncggcccctggacaaggcttggaggtggggtggggtggtcaggcgtctacgtagttggactacaactaaattngacaacgagtaacgttccgaggtacaaggacgtaccaacctagtaaccgacccaaacaacgaaccaacaactacccacgaacgaccaaccacgaccctacgaagtaacgggaaacctagggaacggacgtacccgtaggaacgtaacgttcgtacggaccgaaacggtaccgggtaaccgttaactttaacgtttcgtacgggaccggacgggtaaacggaaacgggtaaacggttaaaaaggtcgggtaaacgggttgggttaaccgggggttaccgggggaactacggtaacgtacggtaaccgtacccggggg

SEQ ID NO: 441019 - DNA, 618 bp, Homo sapiens
  misc_feature: GZ8MTXP02JRW4V.10.88.H11.1.454.CMB.2.raw
  modified_base (268)..(268): a, c, t, g, unknown or other
  modified_base (282)..(282): a, c, t, g, unknown or other
  modified_base (287)..(287): a, c, t, g, unknown or other
  modified_base (361)..(361): a, c, t, g, unknown or other
tcagcatagtagtgcacgaccggtgctcgatttagcgacagcgagaacacacaaaggggatccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcgagtgaagatctcctgcgaggtcttctggttacactttacactanggcatctcgtggtncgacncggcccctaggacaaggtcttggaggtggggtggggtggtcgagcgtacttacgaggtcgactacactaaattntgacaacagtaacgttccgaaggtacagacgtacaaccgatcgaaccacgacgacacactaccgacgacgacacacgacctaacgagtacggaactaggagacgccgtagacgacgtacgacggacgaaccgtaccgggtacgttaacgttacgtttacgacggacggacggacggtaaacggtaaacggtaaaggtcggtaacggttacgggttaaccgggtaccgggggtaacacggtaacgtacggaaaccggg

SEQ ID NO: 441020 - DNA, 548 bp, Homo sapiens
  misc_feature: GZ8MTXP02FF5UK.10.88.H11.1.454.CMB.2.raw
  modified_base (360)..(360): a, c, t, g, unknown or other
  modified_base (374)..(374): a, c, t, g, unknown or other
  modified_base (389)..(389): a, c, t, g, unknown or other
  modified_base (414)..(414): a, c, t, g, unknown or other
  modified_base (440)..(440): a, c, t, g, unknown or other
  modified_base (505)..(505): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctgaggtgaagagcctggggcctcagtgaagatctcctgcgaggtcttctggttactaccttaacacctatcggcatctccgtgggtcgcgacgacggcccctaggacaaggaccttggaggtggggtgggtggcgaggcgcttaacgaagttgctacacaatangcacagacgttacnggacaggactacacntacgacaacgagacacatccacganacacacgctacagtagacgtagacgngcctagagactgtacgacgtacgacggactattacgttctgcgacgagagaaacggttaaacggnggtacggtcggtacggtaccgggactacgacgacgacgtacgg

SEQ ID NO: 441021 - DNA, 594 bp, Homo sapiens
  misc_feature: GZ8MTXP02GG6JW.10.88.H11.1.454.CMB.2.raw
  modified_base (257)..(257): a, c, t, g, unknown or other
  modified_base (277)..(277): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagcgcccgtggggcctgagtgaagatctctgcgagtctctgttacacttaacnctatgcatctccgtgggtcncgacacggcccctggacaaggcttggaggtggggtggggtggtcgagcgtccgttaaccgaagttggacttaacgaactaaaattatgactaacaggtaaacgttccagggaccagtacgtccaacagtcgaacaacagacacacaccacgacgcacacgacctacagtacggaaacgtggaaggacgaccgtaggaagtactccgagacgtacgacggacgtatacgttcgtgacggacgtaagaacggtaaacgtaaaaggtacgtacggtaaggtacggttaccgggggacaacgtacgtacgacgaacccggg

SEQ ID NO: 441022 - DNA, 590 bp, Homo sapiens
  misc_feature: GZ8MTXP02GALUU.10.88.H11.1.454.CMB.2.raw
  modified_base (286)..(286): a, c, t, g, unknown or other
  modified_base (395)..(395): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagagcccgtggggcctcgagtgaagatctcctgcgaggtcttctggttacacctttaacacctatggcatctcctgggtncgacaggcccctggacaaggacttgaggtggggtggggtggtcagcgcttaccaaggttggactaacacaaaattatgacacagaagttccaggacagacgtcacctangaccacagaacacataccaacgacgaccaacacgacctaacagttaaggaaaccgtagaagggagacctaggagagtctaggacgaaccgacggaccgtagtaactttcgagtcggacggaagaacggtacgtaaaaacgtcggacggtaaggtacggttaccggggggaactacgacgtacgacgtaacccggg

SEQ ID NO: 441023 - DNA, 653 bp, Homo sapiens
  misc_feature: GZ8MTXP02HIC62.10.88.H11.1.454.CMB.2.raw
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatctccgtgcgaggtcttcgtggttactacctttaacactatggctatctccgtggtcgcgacgacggcccctaggacaaggtacgttggaggtggggtggggtggtcgaggcgtacttacgagttcgctacactaaagttntcgacacgtagtacgttccgaggtacagacgtaccacagcaaccagacgacacactaccgaacgacaccaacacgacctacgagtaggaaacgtggacggacgtccgtaggacgtactcgtaacggaccgaccgaaccggtaccgtacgttaacgtttcgtacggacgacgggtaaaggtaaacgggtaaacgttaaaaggggtaccggtacggggttaacgggtttaacggggttaaccgggggacgtaacgtaccggtacggacccggtaacccgggg

SEQ ID NO: 441024 - DNA, 696 bp, Homo sapiens
  misc_feature: GZ8MTXP02JN0WM.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagcgcccgtggggcctcgagtgaagatctccgtgcgaggtcttcgtggttaacctacctttaacacctatggctatctccgtgggtcgccgacgcggcccctaggaacgaaggtcttggaggttggggtggggtggtcgaggtccgtacttaaccgaaggttcgacctaaacgaactaaattacgtcgaccaacgtaaggtaacgttccgaggacaaggacgtaccaaccatacgaaccaacgaacgaacacaactacccgaacgacgaccaacaacgacctaacgagttaacggaacgtagggaacggtacgaccgtagaacgtacgtcgtaacggaccggaacgtaaccggtaccgttaagttacgtttacgacggtaccggaacggaaacggtaacggtaaaacggttaaaacggtacgggtaacggttaacgggttaacggggttaaccgggggactacggacgtacggaaccgtaaccggggg

SEQ ID NO: 441025 - DNA, 602 bp, Homo sapiens
  misc_feature: GZ8MTXP02H4MRB.10.88.H11.1.454.CMB.2.raw
  modified_base (220)..(220): a, c, t, g, unknown or other
  modified_base (282)..(282): a, c, t, g, unknown or other
  modified_base (322)..(322): a, c, t, g, unknown or other
  modified_base (379)..(379): a, c, t, g, unknown or other
  modified_base (456)..(456): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtcgtgggctggagtgaagagcccgtggggcctnagtgaagatctctgcgaggcttctggttacacctttaacacctagtggcatctccgtgggtnacgacacggcccctaggacaaggtactttggaggtggggnggggtggtcaggcgtacttaacgaaggttcggactacgaactaaacttatgaccaanaaggtaacttccgaggacaagacgtacaaccatacgaccaacaagaacaacacaccgacgagacaacacgaccctanacgtagacaggacggagcgtagagagtacgagacgacgaacggtacctaagtaactttcgcgaccgacgaagaaggtaaaacgtaaaaggtacggtaacggtaacggtaacggttacgggggacaaccgagtacgaacgaaccggg

SEQ ID NO: 441026 - DNA, 602 bp, Homo sapiens
  misc_feature: GZ8MTXP02FOUY6.10.88.H11.1.454.CMB.2.raw
  modified_base (281)..(281): a, c, t, g, unknown or other
  modified_base (366)..(366): a, c, t, g, unknown or other
  modified_base (418)..(418): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtgggcctcagtgaagatctctgcgaggtcttctggttacacctttaacacctatgcatctccgtgggtncgacacggcccctaggaccaaggtcttggaggtggggtggggtggtcagcgtcttaccgaagtttggactaacgactaaaagttntgacaactagaaacgttcaggacagagttaccaacctagtacgcccaacganacacacaccacgacgaccaacacgactacgatacggaacgtaggaggacgccgtagagactacgacgacgacgacgtaccgtataacgtttcgacgacggacggaagaagtaaaccgtaaaacggtagtaacggttaacgggtaacggttaccgggggacacggtaacgacgtacgtaaccggg

SEQ ID NO: 441027 - DNA, 687 bp, Homo sapiens
  misc_feature: GZ8MTXP02JFTBM.10.88.H11.1.454.CMB.2.raw
  modified_base (206)..(206): a, c, t, g, unknown or other
  modified_base (263)..(263): a, c, t, g, unknown or other
  modified_base (285)..(285): a, c, t, g, unknown or other
  modified_base (290)..(290): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctgggctgaggtgaagngcccgtggggcctcgagtgaagatctcctgcgaggtcttctggttacacctttaacncctatggcattctccgtgggtncgacncggcccctggacaggcttggagtgggtgggtggtcaggcgtcttaccgaggttcggactaacgactaaagttgtgacaacagtaacgttcccaggggtaacctaaggacgttccaaccgtagtacgaaaccctaacgacgaaccgaacactacccgaacgacgaccaaccgacgacctacgagttacggaaaccgtaggaacggtacgtacccgtaggtacgtacgtacgtacggaaccgtaacggaaccgggtaccgttaacgttaacgtttcgtacggtaccggacggtaaacggtaacggttaaaacggttaaaaacggtcgggtaaacggttaacggggttaacgggttacccgggggtaactaacggtacgtacggtaccgtaacccggggg

SEQ ID NO: 441028 - DNA, 622 bp, Homo sapiens
  misc_feature: GZ8MTXP02FGVBD.10.88.H11.1.454.CMB.2.raw
  modified_base (262)..(262): a, c, t, g, unknown or other
  modified_base (275)..(275): a, c, t, g, unknown or other
  modified_base (346)..(346): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccgtggggcctcagtgaagatctctgcgaggcttctggttacacttaacactangcatctcgtgggncgacacggcccctggacaggtcttggaggtggggtggggtggtcagcgacttaccgaaggttcgctacaanaaacttgcgacacaagtaagttccagggacaggagtaccaaccagtacgaaccacacgaacacactaccaacgacgacaacacgcctaacagtacggaactaggaggacgtcgtaggagactcgtacggaccgtaacgaccggtaccgttaacttacgttaccgtcgtaccggacggtaaaggaaacgtaaaaccgggttaaaagtcgggtaaacggttaacggggttaacggggttacccgggggaacgtacgaacgtacggaacgtacccgggg

SEQ ID NO: 441029 - DNA, 735 bp, Homo sapiens
  misc_feature: GZ8MTXP02IO8T0.10.88.H11.1.454.CMB.2.raw
  modified_base (210)..(210): a, c, t, g, unknown or other
  modified_base (292)..(292): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagngcccgtgggcctcagtgaagatctctgcgaggtcttcgtaggttacctacctttaacacctagtggcatcctccgtgggtcncgacacggccccgtaggacaaggcgtttaggaggttggggtcggggtggtcgaggtccgtactttaaccgaaggttcggactaacgaactaaattacgtcgacaacgtaaggtaaccgttccgaagggtacaaggtaaacgtaccaccaagtaccgaacccaaacgaacgaaccaacaacgtaccgaacgaacgaccaacgtaaccgacctaacgagtaacggtaaacgtaagggaacggacgtaccgtaggaacgacgtacgtacggaaccgtaaacggtaccgggtaccgttacgttacgtttacgtacggaccggtacgggaaaacggaacggtaaaacggttaaaaacggtcgggttaaaccgggttaacggggtttaaacggggttaccggggggtaaactaaaccggtaacggtaccggaaacccggtaacccgggg

SEQ ID NO: 441030 - DNA, 736 bp, Homo sapiens
  misc_feature: GZ8MTXP02HAX4S.10.88.H11.1.454.CMB.2.raw
  modified_base (187)..(187): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtncagtcgtgggctggaggtgaagcgcccgtggggcctgaggtgaagatctccgtgacgtaggtcttcgttacggttaacctacctttaacgaccgttagtcggactacttccgtccggtggggtacaccgtacgaccggtccccgtaggaacgtaaggtacgttagggagggttgggggttaggggtcggtacgacggtacccgttaccttaaccggtaaaggttccggtactaaacgtaaacgttaaaacgtttcgacggacctaacggaacgtaacggttccgagggacacggtactccaaccgtagtaccgaaccaaacgacgaaacccactacaccgaacgacgaccgaacgacgtacctagacgtaacggtaacgtagggacgtacgtacctagggaactacgtacgacggaacgaacggaccgttacgttaaagtttcgttacgacggacggaacggtaaaggaaacggttaaaggtaaaacggcggttaacgggttaacgggtacggtaccggggactacgtacgaccgaccggtaaccgggg

SEQ ID NO: 441031 - DNA, 624 bp, Homo sapiens
  misc_feature: GZ8MTXP02GJ0E2.10.88.H11.1.454.CMB.2.raw
  modified_base (209)..(209): a, c, t, g, unknown or other
  modified_base (293)..(293): a, c, t, g, unknown or other
  modified_base (357)..(357): a, c, t, g, unknown or other
  modified_base (359)..(359): a, c, t, g, unknown or other
  modified_base (394)..(394): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtctggggctggaggtgaagngccctggggcctcagtgaagatctcctgcgaggtcttcgtcggttacacctttaacacctatggctatctccgtgggtgcgacncggcccctaggacaaggtcttgaggtggggtggtggtcagcgacttacgagtgctacactaatngnactagagttcaggacagacgtacaccatcgaccanacgacacacacacgagcacacacctacagtacggaactaggacggacgaccgtaggaacgtaactacgtacggaaccggtaacgtaacccggtaccgttagttaacgtttacggtacgaccggacggtaaacggaaacggtaaacggtaaaaacggtcggtaaaccgggttaacggggttaacgggttaccgggggaactacggtaacgtacggaaccgtaacccggggg

SEQ ID NO: 441032 - DNA, 659 bp, Homo sapiens
  misc_feature: GZ8MTXP02G5J6R.10.88.H11.1.454.CMB.2.raw
  modified_base (387)..(387): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagctatccttttcttggtggcagcagcaacagttgcccactcccaggttcagctggtgcagtctgggctggaggtgagagcccgtggggcctcgagtgaagactctcctgcgaggtcttcgtgttactaccttaacacctatggctatctccgtgggtcgcgacgacggcccctaggaacgaggtcgttggaggtggggtggggtcggtcaggtccgtacgttaaccgaggttcggactaacgtaactaaaagtttagngacaacgtaggtaaacgttccgagggaacaggtacgtacaacccgagtacgaacccaacgacgaacacgactacccaacgagaccacgacgacccgacaagtacggaacgtaggaacggagtccgtagaagcgtcgtacgacgtaacgaccggtacgtagttactttacgcggtacggacgtaacggaacggtaaacggtaaaaggtcggtaaggttaacgggtaacggggttaccgggggaactacgtaacggtcggtaaccgtaccgggg

SEQ ID NO: 441033 - DNA, 669 bp, Homo sapiens
  misc_feature: GZ8MTXP02FOGOP.10.88.H11.1.454.CMB.2.raw
  modified_base (392)..(392): a, c, t, g, unknown or other
  modified_base (507)..(507): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagacgcccgtggggcctcgagtgaagatcctccgtgcgaggtcttcgtggttacctacctttaacacctagtcggctatctccgtgggtcgcgacgacggcccctaggacgaaggtcgttggacggtggggtggggtggtcgaggccgtacttaaccgaggtttcgactaacgtaactaaactttancgacaacgaaggtaaaccgtttacccgaggggacaggacgttaccgaacctaagtacgaaccacgacgaacacactaccaacgacgacaacacgacctaacgacgttaggaaacnggaacggacgtaccgtaggaagtacgtacgtacggaccggaaccgaccggtaccgttagttaacgtttcgacgacggtacgaaggaaacggtaaacggtaaaaggtcggtaaggtaacggtacgggttaccgggggactacgtacgtacgacgtaaccgggg

SEQ ID NO: 441034 - DNA, 648 bp, Homo sapiens
  misc_feature: GZ8MTXP02F1UYJ.10.88.H11.1.454.CMB.2.raw
  modified_base (233)..(233): a, c, t, g, unknown or other
  modified_base (290)..(290): a, c, t, g, unknown or other
  modified_base (463)..(463): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagcgcccgtggggcctgagtgaagntctcgtgcgagtcttctggttaccacctttaacacctatcgctatcctcgtgggtcncgacacggcccctggaacaaggcttggaggtggggtggggtggtcacggtccgtacgttaccgtaaggttcggacctaacgaacgtaaaattacgtacgacaacgtaaggtaaccgttacccgagggtacaggtacgtaccacaagtacgacacagaacacgacaccacgacncacacgacacacgtacggaaacgtaggaacggagtcctaggacgtacgtacgtacgacgaacgaccggtaccgtaacgttacgtttacgtcggtacggtcgaaaggaacggtaaacggtaaaggtcggtaacggtaagggtaacggttacgggggaactacggtaacgtacgaccgtaaccgggg

SEQ ID NO: 441035 - DNA, 677 bp, Homo sapiens
  misc_feature: GZ8MTXP02F3ALG.10.88.H11.1.454.CMB.2.raw
  modified_base (232)..(232): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcgagtgaagntctcctgcgaggtcttcgtaggttacctacctttaacacctatggcatctccgtgggtgacgacgtacggccccctaggacaaggacttggaggtggggtggggtgggtcgaggcgtacttaccgtaaagttcggactaacgtaacaaaatttataggaccaacgaagaacgtttaccgagggtaacaaggacgtaccacacgtacgaccaacacgaaccacaactcccaacgacgacaaccacgaccctacgacgtaggaaacgtcggaacggagtaccctagggaactacgtcgacggacgaaccgaccgggtacgttaacgtacgttttacgtacggccgacggtaaacggacggtaaaaccggtaaaaggtacggtaacgggtaacggttaacggggtttaaccgggggacctaacggtacgtacggaccgtaacccgggg

SEQ ID NO: 441036 - DNA, 688 bp, Homo sapiens
  misc_feature: GZ8MTXP02IG57F.10.88.H11.1.454.CMB.2.raw
  modified_base (223)..(223): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctnagtgaagatctcctgcgaggtctttcgtggttaaccacctttaacacctagtggcatccgtccgtgggtgccgacgacgggccccctaggacctaaggcctttggaggttggggtggggtgggtccaggtccgtacttacccgtaagggttcgaccttaaacgaactaaaactttcgtacgaccaacgtaacggtaaacgttcccgaggggtaaccaggtacgtacccaccgtaagtccgaaacccaacgagaacccacacaccgaacgacgacaaccaacgtaccaacgacgtaacggaaccgtaaggaacgacgtaccgaggacgacgttacgagaccgtaacgaccggttacgttaacgttacgttcgtacgtacgaccggtaaaggacggtaaacggtaaacgtcggtacgggtaacgggtacgggttaccgggggacaacggtcgacgaccgtaccgggg

SEQ ID NO: 441037 - DNA, 706 bp, Homo sapiens
  misc_feature: GZ8MTXP02HVQ35.10.88.H11.1.454.CMB.2.raw
  modified_base (364)..(364): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacacggcccctggacaagggtcttggaggtggggtgggttgggtcaggcgcttaccaaggtttcggactacactaaattntcgacacagtaacgttccaggggtaccaggtacgtccaacctaatcggaacccaacgaacgaaccaacctaactacccaaccgacgaccaacctaacggcccttaaacacgtacgggtaaacttagggaacgggtagacccgttagggaacgtacgtacgttacggaaccggtaacgtaaccggggtacccgttacgtttaacttttccgttaggaccggtacggtaacgggtaaacggtaaaaccggttaaaaggttacggtaaacgggtttaacggggttaacggggtttacccggggggaacctaaccggtacggtacggtaacccggtaaccccgggg

SEQ ID NO: 441038 - DNA, 740 bp, Homo sapiens
  misc_feature: GZ8MTXP02JCDLR.10.88.H11.1.454.CMB.2.raw
  modified_base (545)..(545): a, c, t, g, unknown or other
  modified_base (596)..(596): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaaggacgcccgtggggcctcgagtgaagatctccgtgcgaggtcttcgtcggttacctacctttaacacctagtgcatctcgtgggtcgcgacgcggcccctggaacaggtcttggaggttggggtgggtggtcaggtccgtacttaaccgtaaggttcgacctaacgaactaaagtttcgacgacaacgtaaggtaaccgttaccggacggggaacaggtaccgtaccaaccgtaacgtaccggaaacccaacgaacgaaccaactaacacccgaacgacgaccctaacgaccgtacctaacgagtaacgggaactggaaacggcgtaccgaggtanacgtacgtacggaacccgaacggtaccggtaccgttattacgtttaccggnggtaccggaacgggtaaacggaaaccgggttaaaacggttaaaacgggtacgggttaaacggggtttaacggggttaacccggggttaacccggggggtaaactaacgtaacggtacccgggtaacccggttaaaccccggggg

SEQ ID NO: 441039 - DNA, 643 bp, Homo sapiens
  misc_feature: GZ8MTXP02HH1SM.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttcgtggttacacctttaacacctatggcatctccgtgggtcgcgacacggcccctaggaccaaggtcttggaggtgggtggggtggtcaggcgcttaccgagttgctacactaaattatgacacgagaacgttccagggtacaggacgtcaaccatacgaccacgagaacacactaccgaacgagacaacgacgacctacacgtacggaaacgtaggaacggacgaccgtacggagtacgtaccgtacggaaacgaccgaaccggggtaccttaacgttactttcgtacggtccggaacggtaacggaaacggtaaaccggtaaaacggttacggtaacgggttaagggtaacgggttaccggggggaacaaccggtacggtacggtaacgtacccgggg

SEQ ID NO: 441040 - DNA, 792 bp, Homo sapiens
  misc_feature: GZ8MTXP02FZ10T.10.88.H11.1.454.CMB.2.raw
  modified_base (238)..(238): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctggaggtgaagcggcccgtggggcctcgaggtagaagntctcctgcgagtcttctggttacctaccttaacacctagtcgactacgtctccggttggggtcaccggacgaccgggtcccccgtagggaaccgtaaacggtcgtttgggtaacggggttggggggttcggggggttacggtacggaacggtcccggtaacccgttttaaccggtaaagggtttccggacctttaaaacgaaaccgttaaaagtttaccgtacggaacctaaacggtaagttaaacccggttacccgaagggggacctaaagggacgttaccccaaccgtagtaccgaacccaacgaacgaaaccacctaaccgacccgaacgacaccgaaccgaaccgtaccttaacagtaacgggaacgtaggacggacgaccggtagacggtacacgtacggaaaccggtacggaaccggtacccgtttagtacgtttcgtacgggacgtacggaaaggtaaacggtaaaccggttaaaaggacgggttaacggttaaggggttaaccggtaccgggggaactaccggtaggtacggaccggtaacccggg

SEQ ID NO: 441041 - DNA, 684 bp, Homo sapiens
  misc_feature: GZ8MTXP02FS085.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagcgccgtggggcctgagtgaagatctccgtgcgaggtcttcgtggttacctaccttaacacctagtggctatctcgtgggtcgcgacgacggccccgtaggacgaaggtcgttggaggttggggtggggtggtcaggccgtacttaccgaaggttcgactaacaactaaatttagtcgacaacgtaaggtaacgttccgagggtaacaaggtacgtaccaaccgtataccgaaaccaacgacgaaaccaacctactacccgaacgacgaccaacgacgtacctaacgacgtacggaacgtaggacggacgaccgtaggacgtagtacgacggaaccgacggaccggtaccgttattacgtttcgtacggaccggtaacggaacggaacggtaaaacggtaaaacggtacggtaacgggttaacggggttaacgggttaccgggggaactacggtacgtacggtaccgtaaccgggg

SEQ ID NO: 441042 - DNA, 662 bp, Homo sapiens
  misc_feature: GZ8MTXP02F7O5Z.10.88.H11.1.454.CMB.2.raw
  modified_base (224)..(224): a, c, t, g, unknown or other
tcagcatagtagtgcacgaccggtgctcgatttagcgacagcgagaacacacaaaggggacccaaaaaccacatccctccttgggagaatcccctagatcacagctcctcaccatggactggacctggagcattccttttcttggtggcagcagcaacaggtgcccactcccaggttcagctggtgcagtcgtggggctgaggtgaagacgcccgtggggcctnagtgaagatctcctgcgagtcttctggttacacctttaacactatgcatctcgtggtgcgacgacggcccctggaacgaaggtacgttggaggtggggtggggtcgggtcagggccgtaccgtttaacccgtaaaggttggacttaacgaaaccctaaagtttatacggactaaccgaagtaacgttacccagggaacgagacgactaaccgatcgaaccacgaagacaacgactacccgacgacgacaacacgacctaacgaacgttacggaaacgtacggaaggacgtacgtacggacgtaacgttacgacggtaaccgaaccgtaccggtacgttaacgttaactttcgtggaccgacgtaaggaacgtaaacgtaaaggtacgtaacggtagggttaacgggttaccgggggactaaccgtagtacggaaccgg

SEQ ID NO: 441043 - DNA, 586 bp, Homo sapiens
  misc_feature: GZ8MTXP02JKLGP.10.88.H11.1.454.CMB.2.raw
  modified_base (283)..(283): a, c, t, g, unknown or other
  modified_base (474)..(474): a, c, t, g, unknown or other
  modified_base (481)..(481): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttctggtggcagcagcaacaggtgcccatcccaggttcagctggtgcagtctgggctgaggtgaagagccctggggccttcagtgaagatctcctgcgaggcttctggttacaccttttaacacctatggccatactcctggggtcncgacgacggtccccctaggaccaaggacctttggaggtgggggtggggtggttaccaggccgtacttaaccgaaaggtttcggacctaaccactaaaagttctaggctaaccgaggaaagttcccagggaccagtagtcaccatgaacccacagacacatccaacgagcatacgacctacagtagactagngacgccngagatcacgacgacgacgaccgtataacttccgtagcgacgacgaacgaccgtaaaagtcgacgttaacggacgttacgggggacacgtagacgacgtaacccgg

SEQ ID NO: 441044 - DNA, 673 bp, Homo sapiens
  misc_feature: GZ8MTXP02GQQA9.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctccgtgcgaggcttcgtggttacctacctttaacacctatggcatctccgtgggtcgcgaccgacggcccctggacgaaggacgttggaggtggggtgggggtcgggtcgaggccggtcgttaccgtaaggttcggacctaacgaactaaacgtttagtacgactaacgaaggtaacgttaccgaggggtaccaaggtacgtaccaccgatcgaaccacacgacacacgtaccaacgacgacacacgtacctacgagtacggaacgtaggaggacgccgtagagtacgtacgtacgacgacgaccggtaccgtagttacgttcgtacggtcggaccggtaggaacggtaaaacggttaaacggtacggtacgggttaacggggttacgggttaacccgggggacaccggtaacggtaccggtaaccggtaacccgggg

SEQ ID NO: 441045 - DNA, 680 bp, Homo sapiens
  misc_feature: GZ8MTXP02FPZKR.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctccgtgcgaggtcttcgtggttactacctttaacacctatggacatctccgtgggtcgcgacgacggcccctaggacaaggcgttggaggtggggtggggtggtcgaggccgtacgttaaccgaaaggttcggacctaaacgaactaaaattcgtacgacaacgaacgtaaacgttcccgaggggaacaaggtacgtaccaaccctaagtacgaaacccaacgagaaccacactaccgaacgacgaccaacacgacctaacagtacggaactaggaaggacgtccgtagacgtaactcgtacggacgacgacggtaccgtagttacgtttcgaggtacgacggaaaggtaacggtaaaacggttaaaacggtacggtaacgggttaacgggttaacggggttacccgggggaaactacggtaacggtacggaacccgtaacccggggg

SEQ ID NO: 441046 - DNA, 786 bp, Homo sapiens
  misc_feature: GZ8MTXP02FNANL.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctgaggtgaagacgcccgtggggcctcgagtagaagatcctccgtgcgagtcttcgtggtacctaccttaacaccgtatggactacgtctccgtgggtcgcgacgacggtcccctaggaaccgtaaggtaccgttggaggggttcggggttggggtcggtacgaacggcccgtacgtttaacccgtagggttacggtactaaccggtaactaaacgtttacaggacctacggtaacgtaacggtttccgagggacctacgggtactaccaaccgtagtaccgaacccgtaaacgtacgtaaccctaacgtaaccgtacccgaaaccggtaacgaccgtaacctaacgtacccgttaacgaaggttaaccgggaaacgttacgggaacgggtaccgtaccgtagggaacgtacgttaccgtacgggtaacccgtaacgtacccggtaaccgttacgttaaccgtttcgacgggtacgtaacgggtaaacggtaaacggtaaacggtttaaaacggcggttaacccgggttaaggggttaacccgggtaccgggggtaactacggtacggtacggtaacccggtaaccggggg

SEQ ID NO: 441047 - DNA, 659 bp, Homo sapiens
  misc_feature: GZ8MTXP02H2M9Q.10.88.H11.1.454.CMB.2.raw
  modified_base (379)..(379): a, c, t, g, unknown or other
  modified_base (401)..(401): a, c, t, g, unknown or other
  modified_base (421)..(421): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtgggggcctcgagtgaagatctcctggcgaggctttcgtggttaccaccgttttaacacctagtggcattctccgtgggtcgcgacgacggcccctggacaaggacttggaggtggggtggggtggtcaggcgtcttaaccgagttcggactaacacgtaaatttntacgacaacgagtacgttaccngggacagacgtacaacctanacgaaccacagacacacgacacgacgccaacgacgaccctagagttaacgggaactggaagggacgtaccgaggggaataccttagtacgaaccggaacgtacccggggtactacgttttaaacgtttcgcggttaccggacggtaaacggaaagttaaaccgggtaaaacgttggaaccggttgggtaacggggttaccgggggacaacgtaacggttacggaaaccgtcccggggg

SEQ ID NO: 441048 - DNA, 697 bp, Homo sapiens
  misc_feature: GZ8MTXP02F6R62.10.88.H11.1.454.CMB.2.raw
  modified_base (244)..(244): a, c, t, g, unknown or other
  modified_base (286)..(286): a, c, t, g, unknown or other
  modified_base (550)..(550): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagtcaacaggtcgcccacctcccgaggttcagcgtggtgcagtcgtggggctggaggtgaagacgccgtggggcctcagtgaagatcctcgngcgaggtcttcgtacgttacctaccttaacacctagtcggcntcgtcgtggtcgcgacgaccggcccctaggaacgaacggtcgtggaggggttgggggttgggggtggtccgaggtacccggtaccgtttaaccgtaaggttcgaccgtaaacgaaacttaaaccgttagtccggactaacgtaaggtaaccgttacgggaggaacgtaagacgtaccacctagacgaaccacgaacgaactacgacaccgaacgacacgacacgtacacgactaaggaacgtaggacggtacgcgtaacggtanacgttacgacgaccgtaacgaccggtaccgttagtttacgtcgtacggtacggacggtaaacggaacggttaaacggtaaaaggtcggtaaacggttcgggtacgggtaccggggaactacggtacgacggtaaccgtaacccgggg

SEQ ID NO: 441049 - DNA, 668 bp, Homo sapiens
  misc_feature: GZ8MTXP02IVVUZ.10.88.H11.1.454.CMB.2.raw
  modified_base (208)..(208): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagngcccgtggggcctcagtgaagatctccgtgcgtaggtcttcgtaggttacctaacctttaacacctagtggctatcctccgtgggtcgacgacgacggccccgtaggacaaggtacgttggaggtggggtggggtggtacgaggtccgtacgtttaacgaaggttcggactaacgaactaaacgtttagcgacaacgtaagtaaccgttaccgagggactaaggactaccaccgatacgaccaacgacgacacactcaacgacacacgacgacctacagtacggaacgtacggaaggacgtaccgtagacgtacgtacgacgacggaacgtaccggtaccgttagttacgttcgtaggtaccggacgaaaggtaacggtaaacggttaaaacggtcggtaacggttaacgggtacgggttaccgggggaacacgtacgtaccggtaaccgtaacccgggg

SEQ ID NO: 441050 - DNA, 690 bp, Homo sapiens
  misc_feature: GZ8MTXP02G3H3C.10.88.H11.1.454.CMB.2.raw
  modified_base (292)..(292): a, c, t, g, unknown or other
  modified_base (298)..(298): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtgcccactcccaggttcagctggtgcagtcgtggggctggaggtgaagacgcccgtggggcctcgagtgaagatctccgtggcgaggtcttcgtggttaacaccgtttaacacctagtgcatctccgtgggtnccgacncggcccctaggaacaaagggtctttggaggttggggtggggtggtacaggtccgtacttaaccgaaggttcggcctaaacgaactaaaatttagagaccaacgtaagtaaacggttaccccgaggggtaccaagggaacgttaccaacctaagtaccgaaaccaacgaacgaaccaacaactaccaacgacgaccaacgaacgtacctaaccagtaacggaaaccgtaggaacgggacgaccgtaggaacgtacgttacgaacggtaaccgaaccgacgggtaccgtaagttactttcgacgtacggaacgtaacggaaagtaacgtaaaaaggtcggaacggtaagggtacggttacccgggggaactacgacgtaccgacgtaacccggg

SEQ ID NO: 441051 - DNA, 712 bp, Homo sapiens
  misc_feature: GZ8MTXP02JTZSU.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagacgcccgtgggggcctcgagtagaagatctccgtgcggaggtctttcgtcggttaacctaaccctttaacaccttagtggcactcctccgtgggtcgccgaccgaccggccccgtaggaacgaaggtacgttggaggtggggtggggtggtcgacggcgtacttaaccgaaggttcggacctaacgaactaaagttagtcgacaacgtaaggtaacgtttacccgaggggtaacaaggtacgtaccaacccgaataccgaacccaacgacgaacacactacccgaacgacgaccaacgacgtacctaacgagtacgggtaaacgtaggaacgggtacgaccgtaggaacgtactacgtacgaaccggacgtacccgggtacgttaattacgtttacgtcggacggtacggaaaggtaacggtaaacggtaaaacggtcggtaacgggttaagggttaccgggttaccgggggaacacgtacgtacggtaacgtaacccgggg

SEQ ID NO: 441052 - DNA, 616 bp, Homo sapiens
  misc_feature: GZ8MTXP02HEPJ1.10.88.H11.1.454.CMB.2.raw
  modified_base (394)..(394): a, c, t, g, unknown or other
  modified_base (473)..(473): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcgagtgaagatctcctgcgaggcttctggttacaccttaacacctatggcatctccgtggtgcgacgcggcccctggacaaggactggaggtgggtggggtggtcgagtcgcgttacgagttcggactacgtacaaagttatgacacagaagttcaggacagtacgtacacctancgaaccacaagacctacactacccacgagaccacgacgcctaacacgtaggaaacgtggaaggtacgcttacgggaaanacgtcgtacggacgacgtacggtaccgtaagttacgttacggcggacgacggaaaggtaacggtaaacggttaaacgtacggtaacgggtaacgggttaacgggttaccgggggaactacgtacggtacggaccggtaccggg

SEQ ID NO: 441053 - DNA, 631 bp, Homo sapiens
  misc_feature: GZ8MTXP02FG8UZ.10.88.H11.1.454.CMB.2.raw
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgagtcttctggttacaccttaacacctatggcatctccgtgggtcgcgacgacggcccctaggacaaggcttggaggtggggtggggtggtcaggcgcttaaccgaagttggactaacactaaactttangacaacaagtaacgttccgaggaccaggactcgacctagtacgaaccaacaacgacaacactacccacgacgacgacaacgcctaacagtacgggaacgtaggaggacgccgtagacgactcgtacgaccggacaccggaccgttacgttatttcctaggcgacggtaaacggaacggtaaacggtaaaacggtacggtaaccgggttaaggggttaacgggttaccggggggaactaccgacgtaccgacgtaacccggggg

SEQ ID NO: 441054 - DNA, 729 bp, Homo sapiens
  misc_feature: GZ8MTXP02FNI70.10.88.H11.1.454.CMB.2.raw
  modified_base (241)..(241): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagcgccgtggggcctcgagtgaagatctctgcgnggtcttctgttacctaccttaacactatgctatctccgtgggtcgcgacgacggcccgtaggacaaggtcgttggtaggggttggggttggggtcggtacgacggtccgtacgttaacgtaaggttcggactaactaactaaattagtcgacgaacgtaagtaacgttaccgaggaaccgaaggtacgtaccaaccgtagtaccgaaccaacaacgaaccaacgactacccgaacgacgacccaacgaccgtaccctaaacgacgtaacgggtaagtacggggaacggacgtaccgagggtaaacgtaccgtacgtaccgggaaaccgtacccggtaacggtaccgtttaagttacgtttcggtacgggaccgtaacgggaaacgtaaacgggtaaaacggttaaaacgggtcggttaaacgggttaaggggttaacccggggttaccgggggaacaaccggtagtaccggtaaccgtaacccggggg

SEQ ID NO: 441055 - DNA, 575 bp, Homo sapiens
  misc_feature: GZ8MTXP02HWO1A.10.88.H11.1.454.CMB.2.raw
  modified_base (209)..(209): a, c, t, g, unknown or other
  modified_base (247)..(247): a, c, t, g, unknown or other
  modified_base (265)..(265): a, c, t, g, unknown or other
  modified_base (284)..(284): a, c, t, g, unknown or other
  modified_base (369)..(369): a, c, t, g, unknown or other
  modified_base (402)..(402): a, c, t, g, unknown or other
  modified_base (412)..(412): a, c, t, g, unknown or other
  modified_base (414)..(414): a, c, t, g, unknown or other
  modified_base (420)..(420): a, c, t, g, unknown or other
  modified_base (422)..(422): a, c, t, g, unknown or other
  modified_base (453)..(453): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagngcccgtggggcctcagtgaagatctctgcgaggtcttntacggttactaccttaanacctatgcatccgcgtggncgactacggccctaggacaaaggcgttggaggttggggacggggttggacgaggcgtacttaaccgtaaaggttgaaccttaaanaacttaaattcagacaagtagtaacgtcagganagtctaccananacacananacacacacagacacacactacagagtagaangagagtcgagatagcgacgacgacgacgtactatacgtcgtagacgacgtaaggaaacgaacgtaaacggtcggtaacggtaagggtaccgggtacgggaacacggacgtacgaacggtcgg

SEQ ID NO: 441056 - DNA, 742 bp, Homo sapiens
  misc_feature: GZ8MTXP02I3EBH.10.88.H11.1.454.CMB.2.raw
  modified_base (235)..(235): a, c, t, g, unknown or other
  modified_base (277)..(277): a, c, t, g, unknown or other
tcagcatagtagtgcacgaccggtgctcgatttagcgacagcgagaacacacaaaggggacccaaaaaccacatccctccttgggagaatcccctagatcacagctcctcaccatggactggacctggagcattccttttcttggtggcagcagcaacgaggtcgcccactcccaggttcagctggtgcagtcgtgggctggaggtgaagacgcccgtggggcctcgagtgaagntcctcgtgcgagtcttcgtggttaccacctttacactagtgntactctcgtggtcgcgacgacgccccgtagacgaacggtacgttggagggtggggtcggggtgggtcgacggtccgtaccgttaacgtaacggttcggacgtaacaacctaaattagtcgaccaagtaacggaacgtttaccggacggtaacaacggtacgtaccaactaactacgaaccctaacgaacgtaaccaactaacgacccgaaagaccgacaaccaacgaccctaactacggacgtaaacgtaacgggaggaccggtacccgttaaggacgttacttacgggtaccgaaccggtacggtaccccggtaacggtttaacttaacgtttttcccggacgggtacccggagggtaaaacgtaacgggttaaaaaccggtaaaggggttacgggtaacggggttacggggttaaaccgggggttaccggggaaccgtaacgtaacggttccggaaaacccgg

SEQ ID NO: 441057 - DNA, 586 bp, Homo sapiens
  misc_feature: GZ8MTXP02INVTR.10.88.H11.1.454.CMB.2.raw
  modified_base (208)..(208): a, c, t, g, unknown or other
  modified_base (293)..(293): a, c, t, g, unknown or other
  modified_base (429)..(429): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagngcccgtgggggcctcagtgaagatctcctggcgaggtctttcgtggttaccacctttaacacctatcggcattctccgtgggtcncgacgacggcccctggacaaggacttggaggtggggtggggtggtcaggtcgtacgttaccaggtttgactaacactaaatttcagcagagtaaacgtccgaggtacagacgtacaccgatcgaccacagacacancacgagcacacgacctacgatacggaactggacggagccgtaggagagttcgagacgtacgacgtccgtatacgtttacgcgtcgacgaagacgtaaacgtaaaggtacgtaggtaacggttacgggtacgggggactacgacgtcgacgtaccggg

SEQ ID NO: 441058 - DNA, 641 bp, Homo sapiens
  misc_feature: GZ8MTXP02IJZ8H.10.88.H11.1.454.CMB.2.raw
  modified_base (234)..(234): a, c, t, g, unknown or other
  modified_base (380)..(380): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggagggtgaagacgcccgtggggcctgagtgaagntctcgtgcgaggcttcgtgttactacctttaacacctagtcgcactcgtccgtggtcgcgacgccggccctaggaccgaaggtcgttggaggtggggtggggtgggtcaggtgtacttacgtaggttgactaacaactaaagttangacaataggtaaacgttccagggtacaaggcgtaccacctagcgaaccaacagacaacgactaccgaacgacgaccaactacgacctacagtacggtaacaggacggacgtccaggtagacttcgagaacccgacgacggtaccgtagttacttcgacgtcggacgtaaacggaacggtaaaacggtaaaaggtcggaacgggttaacggggtacggggttaacccgggggactacgtacgtaccggaacggtacccgggg

SEQ ID NO: 441059 - DNA, 565 bp, Homo sapiens
  misc_feature: GZ8MTXP02FITTE.10.88.H11.1.454.CMB.2.raw
  modified_base (364)..(364): a, c, t, g, unknown or other
  modified_base (483)..(483): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacctaccttaacacctatcggcatcctccgtgggtgcgacacggcccctggaccaaggacttggaggtggggtggggtgggtcagcgcttaccgaaggttggctacacaaacttangcacagacgttccaggacagagtacacatcgaccacagacacatacacgacgcacacgcctaacatagaactggaggacgccgtagagactactaggacgacgaccggcgtatacttcncgtcgacgaaggaacgtaaacgtaaaacgtaggtacggtaagggttacggttaccgggggacacgagtacgacgtacccggg

SEQ ID NO: 441060 - DNA, 655 bp, Homo sapiens
  misc_feature: GZ8MTXP02I366K.10.88.H11.1.454.CMB.2.raw
  modified_base (265)..(265): a, c, t, g, unknown or other
  modified_base (376)..(376): a, c, t, g, unknown or other
  modified_base (560)..(560): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtgggcctcagtgaagatctcctgcgaggcttctggttacacctttaacacctanggcatctccgtgggtcgcgacgacggcccctaggacgaaggtcgttggaggtggggtggggtggtcaggccgtcttaaccgaaggttcggactaacgaactaaacgtttancgacaactaaggtaaacgttccgaagggactaaggacgttaccaacctaagtacgaaacccaacaacgaccacactacccgaacgacgaccaacacgacctacgactacggaacgtaggaacggacgtaccgtaggaacgtacgttacgacggaaccgtaacgaccggtacgttatacgtttcncggtacgacggaaagaaacgtaacggtaaaacgtcggtaacggtcgggttaacggttaccgggggaaccacgtaacgtacgaaccgtacccgggg

SEQ ID NO: 441061 - DNA, 772 bp, Homo sapiens
  misc_feature: GZ8MTXP02GIYJU.10.88.H11.1.454.CMB.2.raw
  modified_base (290)..(290): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagcgcccgtggggcctgagtgaagatctccgtgcgagtcttcgtggttacctacctttaacacctatggctatctccgtgggtcncgacgacggcccctggaactaaggcttggaggtggggtggggtggtcaggcgtcttaaccgtaaggttcggacctaacgtaactaaaagttttacacgacaaacgtacggtaaacgtttacccgaagggggacctaaaggtaaccgttaccaaaccccgtaagttaaccgggaaaccccaaacgaaaccgaaacccaaaccgaaaccttacccggaaaccgaacggaccaaaccgaacggtaaccctaaacgtaacgtaaacgggtaaacgttacggaacgggtacgacccggttaggaagtaccgttacgtacggaaacccgaacgtaccgggtaacccgttagtttacgtttaccgttacggaccggacggtaaaggtaaacgggtaaaaccgttaaaggtacggttaacgggttaacgggtttaaccgggttaaccgggggaactaaccggtacgtaaccggtaaccgtaacccggggg

SEQ ID NO: 441062 - DNA, 698 bp, Homo sapiens
  misc_feature: GZ8MTXP02JAA4A.10.88.H11.1.454.CMB.2.raw
  modified_base (140)..(140): a, c, t, g, unknown or other
  modified_base (275)..(275): a, c, t, g, unknown or other
  modified_base (278)..(278): a, c, t, g, unknown or other
  modified_base (293)..(293): a, c, t, g, unknown or other
  modified_base (299)..(299): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttntggtggcagcagcaacaggtcgcccactcccaggttcagctggtgcagtcgtggggctggaggtgaagacgcccgtggggcctcgagtagaagtactctccgtgcgacggtcttcgtacggttactaccttaacnctncggcatctcgtggcncgtacncggccctaggactaggtctggtcggtggggtgggtcgtgacgtcgtacttacgtaggttcgactaacgaactaagttacgcgacaacgtaggtaaccgttaccgaggtaacaggtacgttaccaccgtaagttccgaaacctaacgaacgtaaccctaacgtaccgtaccgaaacgacgtacccaaaccggtacgtacccgttaaagacggttaacgaaccgttaggaacggtacgtaccgtaggaagtactcggtacgaaccgtacgacgtacgttaatccgttacggcggacgtacggtaacgtaaacgggtaaacgtaacggtacggtaacggttaacggggttaaccggttaccgggggaacttacgaccggtacgtaaccggttaacccggggg

SEQ ID NO: 441063 - DNA, 696 bp, Homo sapiens
  misc_feature: GZ8MTXP02GVR0U.10.88.H11.1.454.CMB.2.raw
  modified_base (338)..(338): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtgcccactcccaggttcagctggtgcagtctggggctgaggtgaagacgccctggggcctcagtgaagatctcctgcgaggtcttctggttaccacctttaacactagtggcatctcgtgggtcgcgacgcggcccctaggaacaggtacgtttggaggtggggtgggttcgggtacnggcgtacttaaccgaggttacggctaaacataaaattgtagacaacgtagtaaacggttccgagggaaccaggtaacgtaccaaccgtatacggaacccacgaacgaacaaccactaccaacgacgaccaacacgacctaacgaagtacggtaacgtacggaggacgtccgtagaacgtacgtaccggttaggaaccggtaaccgacccggttaccggtaactttacgtttacgtcggtaccggaggtaaacgggtaaacggtaaacggttaaaaacggttgggttaaacgggtaacggggttaaacggggttacggggggtaacacggtaacggtacggtaaaccggtaacccgggg

SEQ ID NO: 441064 - DNA, 562 bp, Homo sapiens
  misc_feature: GZ8MTXP02G3C6R.10.88.H11.1.454.CMB.2.raw
  modified_base (193)..(193): a, c, t, g, unknown or other
  modified_base (241)..(241): a, c, t, g, unknown or other
  modified_base (276)..(276): a, c, t, g, unknown or other
  modified_base (281)..(281): a, c, t, g, unknown or other
  modified_base (378)..(378): a, c, t, g, unknown or other
  modified_base (458)..(458): a, c, t, g, unknown or other
  modified_base (464)..(464): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgnggggctggaggtgaagagcccgtggggcctgagtgaagatctctgcgnggtcttgtgtactaccttacactatgcatctccgngggtncgacgagcccctaggacaaggcgttgaggtggggtgggtggtacgacgcgtactacgagttcggactacactaaacttgatcacaggtaacttccgngggacagagtaccacctatacgaccagacacacactaccgaacgacgacactacgactacgagtacggactggaaggtcncgagancgtacgacgacgacgtacggtactatcgttcgagcgacgtagacgtaacgaacgtcggtacggtaacggtcggtaacggacacgtacgacgacgacgg

SEQ ID NO: 441065 - DNA, 712 bp, Homo sapiens
  misc_feature: GZ8MTXP02FOOAY.10.88.H11.1.454.CMB.2.raw
  modified_base (294)..(294): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacgaggtcgcccactcccaggttcagctggtgcagtctggggctgaggtgaagacgccgtgggcctcgagtgaagatctccgtgcgaggtcttctggttaccacctttaacacctatcggactatcgtccgtgggtcncgacgacggcccctggacaaggtcgttggaggtggggtggtggtcagcgtacttaccgaaagttcgactaacgtacgtaaattatcgacgaacgaggtaaacgttccgagggaccgaagacgttaccaaccgaataccgaaccaaacgacgtaaaccacgtaactacccgaaacgacgaccaacgaacgtaccaaacgtacgaacggtaacccgtaggacgggtaacgccgtaggaagtaaccgtacgtaccggaacggaaccgtacggtaccgttaacttaacgtttccgaggtaccggtaacggtaaacggtaaaacggtaaaccggtttaaaaagggtcggttaaaaccggggttcgggttaaacggggttaccgggggaaactacgtaacggttaccgaaccggtaaccggggg

SEQ ID NO: 441066 - DNA, 628 bp, Homo sapiens
  misc_feature: GZ8MTXP02GZM8Y.10.88.H11.1.454.CMB.2.raw
  modified_base (366)..(366): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagacgcccgtggggcctcgagtgaagactctcctggcgaggcttcgtggttaacctacctttaacacctagtggcatctccgtgggtgcgacacggcccctaggacaaggcttggaggtggggtggtggtcagcgcttacgagttgctacactaaatngacacgagtagttcgagacagagtaccaactatacgaacccacacgacacactaccaacgagacacacgacctacagtacggaacgtaggaacggacgaccgttagggacgtaacgttcgtacggaaccgaacgtaccggtaccgttaattacgtttacgtcgacgtacggaaacggaaacgtaaaccggtaaaaggtcggtaacggttaagggtaacggtttaccgggggacaacgtacgttacggaaccgtaacccgggg

SEQ ID NO: 441067 - DNA, 617 bp, Homo sapiens
  misc_feature: GZ8MTXP02F1NNG.10.88.H11.1.454.CMB.2.raw
  modified_base (221)..(221): a, c, t, g, unknown or other
  modified_base (229)..(229): a, c, t, g, unknown or other
  modified_base (260)..(260): a, c, t, g, unknown or other
  modified_base (278)..(278): a, c, t, g, unknown or other
  modified_base (283)..(283): a, c, t, g, unknown or other
  modified_base (339)..(339): a, c, t, g, unknown or other
  modified_base (346)..(346): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcctggggcctnagtgaagntctctgcgagtcttcgtggttacacttaacncctatgcatctctgggtncgacncggccctggacaaggctgagtgggtggtggtcagcgctaccgagttgactaacganaaacttntgacaacaggtaacgttccagggaccaggacgtaccaccgtatcgaaccacagaacacaacaccaacgacgaccaacacgacctaacgagtacggaaactacggaacggacgaccgttagaaggtaactacgtacggaacgaacgtaccggtaccgtaacttacgtttacgtcggtacgaccggaaaggtaacgtaaacgtaaaaggtcggtaaacggtaacgggttaacggttaccgggggaactacggacgtacgaacgtaacccgggg

SEQ ID NO: 441068 - DNA, 658 bp, Homo sapiens
  misc_feature: GZ8MTXP02FK15O.10.88.H11.1.454.CMB.2.raw
  modified_base (285)..(285): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagacgccgtgggcctcgagtgaagatctccgtgcgagtcttcgtgttaacctacttaacactatgctatctcgtgggtncgacgacggcccctaggacgaaggtcgttggaggggttgggggtggggtggtcgaggccgtacttaccgtaaaggttggactaacgactaaaacttatcgacaacgtaggtaacgtaccgagggacaacgtagtacccactaagtccgaaacccaaacgacgaaaccactaactccaacgacgaccaacgacgacctaacagtaggaaacgtggacgtagaccgttagaagtacgtacgtacgacgacgacggtccttaattacgttacgtacgcgtacggaaggtaaacgtaaacggtaaaaggtcggtaacgggtaacgggttaacgggtaccgggggtaaccgacgttacggacgtaccggaacccgggg

SEQ ID NO: 441069 - DNA, 621 bp, Homo sapiens
  misc_feature: GZ8MTXP02F3UYV.10.88.H11.1.454.CMB.2.raw
  modified_base (207)..(207): a, c, t, g, unknown or other
  modified_base (356)..(356): a, c, t, g, unknown or other
  modified_base (436)..(436): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngcccgtggggcctcagtgaagatctcctgcgaggtcttctggttacacctttaacacctatgcatctccgtgggtcgcgacacggcccctggacaaggcttgaggtgggtggggtggcagcgcttaccgaagttgctaacactaaattntgacacaaggtaacgttccaggacagtacgtccaccatcgaccacaacgacaactacaccacgaacgcacacgccctaanacgtaggaacgtggacggagccgtagagacgttaccgacggtaacgaaccggtaccggtaccgttaacgttaactttcgtcggtacggaaccggtaagaaacggtaaacgtaaaacggtaggtaacggttaagggttaacggggttaccgggggaactacggtacgtaacgggaccgtaccgggg

SEQ ID NO: 441070 - DNA, 846 bp, Homo sapiens
  misc_feature: GZ8MTXP02IIL5I.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagtactctccgtggcgaggtctttcgtaggttaacctaccctttaacacctagtcggactatcctccgtgggtcgaccggaccgacgggcccctaggaaccgaagggtactttaggagggttgggggtggggtggtacgaggtaccgtacgttaaccgaaggtttcggacctaaacgtaactaaaagtttacgtacggacctaacgtaaaggttaacggttacccgaaggggtaactaaacggtaaccgttaccccaaaacccgtagttaaaccgaaacccccgaaacgaaacggaaacccaaacccgaaccgtaacccgaaaccggacgacccaacaacggtaccctaaacgtaagtaaacggtaaaccgtagggaaacgggtaccgtacccggttaggaaacgtaacgtaccggtaaccggtaaaccggtaaacccggtaaccgggttaaccgtttaaacgtttaaccgttttacggaacgggtaccggtaacggtaaaggaaaacggttaaaccggggttaaaaaggtccggtaaacgggttaacggggttaaccggggttaacccgggggaactaaaccggtaggttaaccggaacccggttaacccggggg

SEQ ID NO: 441071 - DNA, 701 bp, Homo sapiens
  misc_feature: GZ8MTXP02JA8SU.10.88.H11.1.454.CMB.2.raw
tcagcatagtagtgcacgaccggtgctcgatttagcgacagcgagaacacacaaagggacccaaaaaccacacccctccttgggagaatcccctagatcacagctcctcaccatggactggacctggagcattccttttcttggtggcagcagcaacaggtcgcccactcccaggttcagctggtgcagtctggggctggaggtgaagcgcccgtggggccctcgaggtagaagtactccttccgtgcggaggtctttccgtacggttaacctaccctttaacgacccttagtcggctacttccgtcgtgggtgccgacgcggcccctaggacgaaggtcgttggagggtggggtggggtggtcgacgccgtacgttaaccgtaggttcggtacctaaacgtaactaaagttacgtacgacgaacctaaggaacgttacccgaggggacctaaaggtaccgtaaccaaccgtaagtacgaaacccaaacgaaccgaacaacccactacccgaacgacaccgaacgaccgacctaaacgacgttagggaaaccgtggaaacgggtcgaccgtaggagtacgtacgtacggaaccgtcgtaaccgtacgttattacgttcgtcgcggacgtaggaaacgtaacgggtaaacgtcggtaacggtgggttacggtacggggaccaagacgtacgacgtacccggg

SEQ ID NO: 441072 - DNA, 688 bp, Homo sapiens
  misc_feature: GZ8MTXP02GPG5L.10.88.H11.1.454.CMB.2.raw
  modified_base (300)..(300): a, c, t, g, unknown or other
  modified_base (507)..(507): a, c, t, g, unknown or other
  modified_base (525)..(525): a, c, t, g, unknown or other
  modified_base (559)..(559): a, c, t, g, unknown or other
  modified_base (575)..(575): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcgagtgaagatctccgtgcgagtcttcgtacggttaactaccctttaacacctagtggactactcctccgtgggtacncgtaccgacggccccctaggaacctaaaggtaccgttgggtaacggggttgggggttacgggggtcggggttaccgaacgggtcccggttaacccggtttaaccgtaaacgggttttcggggaacccttaaacgtaaccttaaaatttagacgtacgaacgtaacggtaacgttaccgaggaacagacgtacaccaagtcgaccaanacgacactacacaacganacacacgacctagacgtaggtaacaggacggacnccgtagacgataccgngaaccgacgaccgtcttaaatcgttacgcggacgcgaaacgtaacgtaacgtaaaacggtcgtaggtaacgggtaacggtaccggggacacgtaacgcgaaccgttaccgggg

SEQ ID NO: 441073 - DNA, 655 bp, Homo sapiens
  misc_feature: GZ8MTXP02GCW6N.10.88.H11.1.454.CMB.2.raw
  modified_base (231)..(231): a, c, t, g, unknown or other
  modified_base (433)..(433): a, c, t, g, unknown or other
  modified_base (478)..(478): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagcgccgtgggcctgagtgaagntctcgtgcgagtcttcgtagttactaccttaacactagtcgctactctccgtgggtcgcgacgccggcccctaggaacgtaaggcgttggaggtgggggtggggtggtcaggtccgtacttaacggtaaggttcgactaaacgtaacttaaacttgtacgacaacgtaagtaaccgttacgaggtacaggactaccacgtancgaaccacgagaccactacaccgacgagcctaacgacgacctaanacgacggtacaggaggacgtaccgtagacgtactacggacgacgacgtaccggtacgttaattcgttacgcggacggacggtaaagtaaaacggtaacggttaaaaggtcggtaaacgggttaacgggttaaccggggttcggggaactacgtacggtaccgaccggtaacccgggg

SEQ ID NO: 441074 - DNA, 735 bp, Homo sapiens
  misc_feature: GZ8MTXP02F3Q8W.10.88.H11.1.454.CMB.2.raw
  modified_base (290)..(290): a, c, t, g, unknown or other
  modified_base (394)..(394): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctgaggtgaagacgcccgtggggcctcgagtagaagtatctcgtgcgaggtcttgtgtaacctaccttaacactagtggcactcgttccgngggcgaccgacgaccgccccgtaggaacgaacggtcgttggaggggtggggtggggtggtcgaggtcgtacttaaccgtaggttcgactaactaaataaacttntcgacacgtaagtaacgttacgaggaccaaggacgtaccacctaagaccgaacccaaacacgtaaccaacaccgtaccgaacgaacgcccctaagaaccgtacctaaacgtaagttaaccggggaaacgtaacgggacggaccgtaccggtaggacgacgtttaccggacgaaaccggtaccggtaccggtaccgtttaagtttacgtttcggacggcggaaacggtaaaggaaaccggttaaaacggttaaaagggtcggttaaaaccgggggttaacggttaaaccgggggtttaaccgggggaactacggtacggtaccggaccggtaaccccggggg

SEQ ID NO: 441075 - DNA, 726 bp, Homo sapiens
  misc_feature: GZ8MTXP02FG8VG.10.88.H11.1.454.CMB.2.raw
  modified_base (187)..(187): a, c, t, g, unknown or other
  modified_base (519)..(519): a, c, t, g, unknown or other
  modified_base (548)..(548): a, c, t, g, unknown or other
  modified_base (568)..(568): a, c, t, g, unknown or other
tcagcatagtagtgcacgaccggtgctcgatttagcgacagcgagaacacacaaaggggacccaaaaaccacacccctccttgggagaatccccctagatcacagctcctcaccatggactggacctggagcatccttttcttggtggcagcagcaacaggtcgcccactcccaggttcagctggtncagtcgtgggctgaggtgaagacgcccgtggggccctcgagtagaagtatcctcctgcgaggtcttcgtaggttacctaacctttaacacctagtcggactacgttcctccggtgggtcgaccgtaccgaccggccccgtaggaaccgaaggtcgtggagggttgggggtggggttcggtcgacggcccgtaccgttaaccggtaacggtttcggactaaaccgaaacgtaaacctttacgcggaacaacgtaaggtaaccgttaccgacggacaaggtacctaccaacctataccgaaacccaacgaacgaacactaacgacccaacgacnccgtaacacgtaccactaagacggtaacnggaacgcgtacgtaggaacncgtactacggaaacgacgacccgggtactttacgtaactttccgacggccgtaggaaacggtaacggtaaaaccgttaaaaggtcggtaaagggttaacgggtaaccggggtttacccggggaaacttcgaaacggttcccgaccgtaaccccggggg

SEQ ID NO: 441076 - DNA, 685 bp, Homo sapiens
  misc_feature: GZ8MTXP02FGMPO.10.88.H11.1.454.CMB.2.raw
  modified_base (289)..(289): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtgggctgagtgaagcgcctggggcctcagtgaagactctctgcgaggtcttgtcggttaacctaccttaacacctatggactactctccgtgggtcncgacgtacggcccctaggacgtaaggcgtttgggagggttggggtgggggtcggtcacggcgtacttaaccgtaaggtttcggacctaacaacgtaaatttacgcacacgtaagtaacgttcccgagggaccaggtataccaactagtcaacccacaacgacacactaccgaacgacgaccaacacgtacctacgacgtacggaacctggacggtacgaccgagacgacgtacgtacgaaccggaacgaccggacgttaacgttacgtttacgtcggaccggtaggaaacggtaacggtaaacggttaaaacggtacggtaacgggttaacggggttaacggggttacccggggggaaccttaacggtaacgtaccggtaccgtaaaccccggggg

SEQ ID NO: 441077 - DNA, 683 bp, Homo sapiens
  misc_feature: GZ8MTXP02GNMHJ.10.88.H11.1.454.CMB.2.raw
  modified_base (263)..(263): a, c, t, g, unknown or other
  modified_base (280)..(280): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctctgcgaggtcttctggttacacttaacnctatgcatctcgtggtncacgacggcccctaggacaaggcttggaggttggggtcggggtagggtcaggtccgtacgttaaccgtaaaggtttcggaccttaaacgaacgtaaaaatttacgtaggactaaaccgtaaggtaaacgtttcccgagggtaaaccaacggaacgttacccaacgtaagacgaaaccccaagaacgaaccaaacactacccaacgagaccaacgtacgaccctaacgacgtaacggaaacgtaggaacgggacgacctagggaaacgacgttacgaacgaccggaacgaccggggtaccttaaagttaccgttcgtacggacggtcggaaagacggtaaaaccgtaaaaggttgaccggttaaggtacggttacgggggactaacgacgtacgaccgtacggg

SEQ ID NO: 441078 - DNA, 644 bp, Homo sapiens
  misc_feature: GZ8MTXP02G69RA.10.88.H11.1.454.CMB.2.raw
  modified_base (193)..(193): a, c, t, g, unknown or other
  modified_base (265)..(265): a, c, t, g, unknown or other
  modified_base (271)..(271): a, c, t, g, unknown or other
  modified_base (304)..(304): a, c, t, g, unknown or other
  modified_base (317)..(317): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgngggctggagtgagagccgtcgggcgtctagagaagatctctcgcgagtcgttctgtactaccttaacactangcatcncgtggtgcgacgacgccgcgtagaagtacgtgnggtagggtggggnggtgcgtcgtcgtactaaggtggtcaactacaaattatcgacacgtaagtagttaacgcgaagagactaccgaacactacgacccaaacacaacgaaccactacacgacgccaacgtacgacctacacgtagaacgtaggaagacggtcctaggacgagttacgaccgacggaaccggaccggttaccggtaacttagttacccgttggtaaaccggaccggaaaggttaaacggtaaacgggtaaaacggtacggttaacggtaacggggtaaacggtttacccggggggtaacgaacctacgggtaacgacggttaaccccgggg

SEQ ID NO: 441079 - DNA, 699 bp, Homo sapiens
  misc_feature: GZ8MTXP02JJE25.10.88.H11.1.454.CMB.2.raw
  modified_base (260)..(260): a, c, t, g, unknown or other
  modified_base (267)..(267): a, c, t, g, unknown or other
  modified_base (491)..(491): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctctgcgagcttgtgttacaccttaacnctatgcntctcgtgggtcgcgacgacggcccctaggaacgaggtcgttaggacggtggggtggggtcggtacgaggccgtacttaaccgaggttcggactaaacgtaactaaaatttacgtagacctaaccgtaaggtaaacgtttaccccggagggacgttacggaggttacccaccgaagtacgacccaaacgagaaccacacgacgacgacaccacacgtaccctaanacgtaagggtaacctagggaacggtacgtcccgtaaggaaccgtagtaccgtacgaccgaaacgtccggggtaaccctagtttaacgttaccggttcggacgggtaccggtaaagggtaacggtaaaaccggttaaaaaggtcggtaacgggtaacgggttaaccgggttaccgggggaacgaccgtacggtacgaaccggtcccggg

SEQ ID NO: 441080 - DNA, 623 bp, Homo sapiens
  misc_feature: GZ8MTXP02FM2RT.10.88.H11.1.454.CMB.2.raw
  modified_base (206)..(206): a, c, t, g, unknown or other
  modified_base (255)..(255): a, c, t, g, unknown or other
  modified_base (367)..(367): a, c, t, g, unknown or other
  modified_base (400)..(400): a, c, t, g, unknown or other
tcagcatagtagtgcacgaccggtgctcgatttagcgacagcgagaacacacaaaggggacccaaaaacccacacccctccttgggagaatcccctagatcacagctcctcacccatggactggacctggagcatccttttcttggtggcagcagcaacaggtgccccactccccaggttcagctggtgcagtctgggctgaggtnaagagccctggggcctcagtgaagatctcctgcgaggcttctggttacncctttaacacctatggcatctcctgggtgccgacagggcccccctggtaccagggacctttggaggtggggttgggtgggtcagcgcttaccagtttggctacacaaacttntgcacagacgttccagaccagagttccaacccnctacgaccaacaagaccaactcacccgaacgacaccgaacacgccctaacagtaggacctaggacgaccgccccggacgtactcctagaccgaccgaccggtaccgttaattactttcgtcgcgacgaacggaaacgaaaccggttaaaacgtacgtaaccgggttaggtaaccgggttacccgggggaaacaactacgtacgtaaccgacccgggtcggggg

SEQ ID NO: 441081 - DNA, 686 bp, Homo sapiens
  misc_feature: GZ8MTXP02JZ0QX.10.88.H11.1.454.CMB.2.raw
  modified_base (391)..(391): a, c, t, g, unknown or other
  modified_base (396)..(396): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcaggtgaagatctcctgacgaggtcttcgtcggttaccaccgtttaaacaccttatcggcatccgtccgtggggtcgccgtacgacggccccctaggaccaagggtactttggaggttcggggtggggtgggtcgaggcgtacttacgaaggttcggctaacactaaattngcaanagtaacgttccagggtacaggtagtccaactatacggaccacaacgacacactaccacgacgacactacgacctacaacgtggaaaccgtggaacggacgaccgagggaacgtaactccgttacgggaaaccgaccggtaaccgggtaccgttaacgtttaacttttccggacggtaccgggaacggaaaggtaaccggtaaaacggttaaaacggtacgggttaacggggtaacggggttacgggtaaccgggggtacaacgtacggtacggaacccgtaacccggggg

SEQ ID NO: 441082 - DNA, 653 bp, Homo sapiens
  misc_feature: GZ8MTXP02JUQ0B.10.88.H11.1.454.CMB.2.raw
  modified_base (232)..(232): a, c, t, g, unknown or other
  modified_base (397)..(397): a, c, t, g, unknown or other
  modified_base (420)..(420): a, c, t, g, unknown or other
  modified_base (452)..(452): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgccgtgggcctgagtgaagntctctgcgtaggtcttcgtaggttacctacctttaacaccgtagtcggctattccgtccgtggggtcgccgacaccgggtccctggaacaaggtcgttggagggtggggtaggggtcggtagcggtcgtaccgttaacgtacggttgactaacaactaaagttcngacaagacgtaacgtcacggganaaggtacgtacccatactacgaacccaacganaacacacgaccgaacggacacctaacgacgacctacgagtacggaccgtggaacggtacgcgtggaaactcgttacgacggaccgtacggacggttacctaagttacgtttacgacgtccgggacgtaaaggacgttaaacgggtaacgtcggtacggtaaggtacgggttaccgggatacgtacggacgcggtaaccggg

SEQ ID NO: 441083 - DNA, 651 bp, Homo sapiens
  misc_feature: GZ8MTXP02JKWG9.10.88.H11.1.454.CMB.2.raw
  modified_base (191)..(191): a, c, t, g, unknown or other
  modified_base (207)..(207): a, c, t, g, unknown or other
  modified_base (220)..(220): a, c, t, g, unknown or other
  modified_base (224)..(224): a, c, t, g, unknown or other
  modified_base (282)..(282): a, c, t, g, unknown or other
  modified_base (287)..(287): a, c, t, g, unknown or other
  modified_base (362)..(362): a, c, t, g, unknown or other
tcagcatagtagtgcacgaccggtgctcgatttagcgacagcgagaacacacaaagaggacccaaaaaccacacccctccttgggagaatcccctagatcacagctcctcaccatggactggacctggagcatccttttcttagtggcagcagcaacaggtgcccactcccaggttcagctggtgcagtcnggggctgaggtgaagngccctggggcctnagtnaagatctcctgcgagcttcgtggttactacctttaacacctagtgcatctcgtggtcncgacnggcccctggacaggacttggaggtggggtggggtggtcagcgtcttacgagttcgactacaaccgtaaattacgngactacgaagtaacgttccgaaggtacaaggtactccaacctagtacgaacccacgaacgaacaacactacccgaacgacgaccgaaaccgacaccctaacgacgttacggaaaccgtaggaacggacgaccggtaagacgtacgtacgtacggaaccgacgtaccggtcgttaacgttactttacgacgtccggacggtaaacgaacggtaaaaccgtaaaggtacggtaacgggttaacgggtaccgggttaaccgggggacaacggtaacggtacggtaacccggg

SEQ ID NO: 441084 - DNA, 661 bp, Homo sapiens
  misc_feature: GZ8MTXP02F919G.10.88.H11.1.454.CMB.2.raw
  modified_base (469)..(469): a, c, t, g, unknown or other
  modified_base (562)..(562): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagccctggggcctcgagtgaagatctcctgcgaggtcttctggttacaccttaacacctatggcatctacgtgggtcgcgacacggcccctggacaaggacttgaggtgggtggggtggtcaggcgacttaaccgaaaggttggactaacgaactaaaattactacgacaacgtagaaacgtttccgacggggtacaaggtacggtaccaaccgtacgtacggaacccaacgaacgaaccaactaacgtacccaacggtanacccaacgtacgaccttaaacgagtaacggaacgtaggacggaacgccgtaggaagtacgtcgtacgacgacgacggaccgtatacgtttcgngtaccggacgacggaacgtaaacggtaaacgtacggtacggttaacgggtacgggttaccgggggaaactaacgtacggtacggaaccgtaacccgggg

SEQ ID NO: 441085 - DNA, 680 bp, Homo sapiens
  misc_feature: GZ8MTXP02HC1N8.10.88.H11.1.454.CMB.2.raw
  modified_base (266)..(266): a, c, t, g, unknown or other
  modified_base (460)..(460): a, c, t, g, unknown or other
  modified_base (530)..(530): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtgggctggaggtgaagcgcccgtggggcctgagtgaagatctcctgcgaggcttctggttacaccgtttaacnctagtggctactctcgtggtcgcgacgacggccccgtggacaggtacgtggaggttggggtggggtggtacgaggtccgtacgtttaaccggagttcggactaaaccgtaataattactaggctaacgaaggtaaccgttaccgaggggacaaggtacgtaaccacccaagtaccgacccaaacgagaacccanactaccccgaagacacaacaccggaccttaaccgaggtaaacggaacgtgggaaggccgaccttaggganaccgtatacggaacgccgtaccggtaccgttattaccgttcgacggtacggacgtaaggaaacgttaacgggtaaaagttccgggtaagggttaacgggtcggggttacccgggacgaaccgttaacgtacgggaaccccggtaccgggg

SEQ ID NO: 441086 - DNA, 641 bp, Homo sapiens
  misc_feature: GZ8MTXP02JGPN7.10.88.H11.1.454.CMB.2.raw
  modified_base (286)..(286): a, c, t, g, unknown or other
  modified_base (367)..(367): a, c, t, g, unknown or other
  modified_base (489)..(489): a, c, t, g, unknown or other
  modified_base (542)..(542): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctctgcgaggtcttcgtggttacacctttaacacctatggcatcctccgtgggtcncgacgacggcccctaggacaaggcttggaggtggggtggggtggtcagccgtcttacgaagttcggactaacactaaattntgacacgaacggtaacgttccagggtacaaggtacgtaccaactagtacgaccaacgaagaaaccacgactacccgaacgacgcccaacgacgtacctacacgttacggaacgtggaacggngtaccgtgaagtacgtcgtaggaaccgacgaccggtccgtaattacgtttacncggacgtacgagtaaacggtaacgttaaaacggtcggtaacggttcgggtaacggggttaccgggggaactacgtacgtacggaaccgtaacccggggg

SEQ ID NO: 441087 - DNA, 705 bp, Homo sapiens
  misc_feature: GZ8MTXP02G8Z5H.10.88.H11.1.454.CMB.2.raw
  modified_base (276)..(276): a, c, t, g, unknown or other
  modified_base (284)..(284): a, c, t, g, unknown or other
  modified_base (290)..(290): a, c, t, g, unknown or other
  modified_base (332)..(332): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggcttcgtggttacacctttaacacctagtgcatcnccgtggtncgacgnggcccctaggacaggctttggaggtggggtaggggtggtacnggcccgtactttaacgaggttcgactacgaactaaaagttgtacgacaacgtaaggtaacgtttacccgaggggtaaccctaagggacgttacccaaccgtaagtaccgaacccaaaccgaacgaaacccactaaccgtaacccgaaacccgaacgaacccaaccgaaccgtaccgtaaaccgtaacgaacgggtaaacgtacggacggaacgtacccgtaggaacgaacgtcgtaacgaccggaacgtaccggtaccgttacgttacgttacgtacggccgacgggacgtaaacggtaaacgtaaaacggtacggtacggtaacgggtaacggttaccgggggactaccggagtacggaccgtaacccgggg

SEQ ID NO: 441088 - DNA, 756 bp, Homo sapiens
  misc_feature: GZ8MTXP02JI7OR.10.88.H11.1.454.CMB.2.raw
  modified_base (284)..(284): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtgggctggaggtgaagagcccgtgggcctcgagtgaagatctcgtgcgaggtcttcgtggttactaccttacactatgctatctcgtggtncgacgacggccctaggacaaggtcgttggaggttgggggttggggtgggtcacggtccgtcgttaaccgtaggttacggactaaacgtaactaaaagtttgacgacacgtaaagtaaccgttacgacgggaccaaggtaccgtaccaaacccgtataccggaaacccaaacgaagaaacccaacaacgtacccgaaacgacgaccaaaccgtaacgtacccttaaacgaacgtaaggaaaccgttgggaaacggtaccgcgttaacgaacggttaccttacgtaccgggaaaccggaacccgtaaccggtcgtttaacttacggtttaccggtacgggacgggaaacccgtaaggggttaaaccgtaaaacgggtttaaaaacgggttcgtaaaacggggttaaccgggtttaaccggggttaacccgggggaacctaagttaaccggtacgggtaccccgaaacccggggg

SEQ ID NO: 441089 - DNA, 670 bp, Homo sapiens
  misc_feature: GZ8MTXP02JW5NB.10.88.H11.1.454.CMB.2.raw
  modified_base (97)..(97): a, c, t, g, unknown or other
  modified_base (436)..(436): a, c, t, g, unknown or other
tcagcatagtagtgcacgaccggtgctcgatttagcgacagcgagaacacacaaaggggacccaaaaaccacacccctccttgggagaatcccctanatcacagctcctcaccatggactggacctggagcatccttttcttggtggcagcagcaacaggtgcccactcccaggttcagctggtgcgagtcgtggggctggaggtgaagacgcccgtggggcctcgagtgaagactctccgtgcgagtcttcgtaggttacctaacctttaacactatggctatctccgtgggtcgacgacgacggccccgtaggaacgaaggtcgttggaggtggggtggggtggtcgaggtccgtcgttaaccgaggttcggactaaacgaactaaacttagtacgacaacgagtaacgttaccaggacaggacgtacacctanacgaaccacacgaacactacaccacgacgaccaacgacgaccctagagtacggaacgtacggaaggacgtaccgtaggacgacgttacgtacggaaccgtaaccgaccggtacgtttaacttcgtttcgacgacggacggaaaggtaacgggtaaaccgttaaaggtacggtaacggttaacgggtaccggggttaaccgggggacaacgtacggtacggaaccgtaccggggg

SEQ ID NO: 441090 - DNA, 597 bp, Homo sapiens
  misc_feature: GZ8MTXP02HEJSG.19.3.A03.1.454.CMB.2.raw
  modified_base (351)..(351): a, c, t, g, unknown or other
  modified_base (461)..(461): a, c, t, g, unknown or other
  modified_base (468)..(468): a, c, t, g, unknown or other
  modified_base (470)..(470): a, c, t, g, unknown or other
  modified_base (473)..(473): a, c, t, g, unknown or other
  modified_base (475)..(475): a, c, t, g, unknown or other
  modified_base (478)..(478): a, c, t, g, unknown or other
  modified_base (532)..(532): a, c, t, g, unknown or other
tcagtactctcgtgcacgaccggtgctcgatttagagagcgtcacagagaggaaggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggagcttggtccagccgtggggggtccctgagactctcctgtacaggctcgtgggttctcctttagtagttattggatgaactgggcccgccgaggcgtccgggggaaaggggccggaggtggggtggacccaaanataaatgcaaagatagggaactgaaagaaaaaactagtaggggactgtgtgaaaggggccaattccaaccaatctccaagagaacaaaccgtaagaaacttactgtttcngacaaananaananacngagagacgacgacgacgcgtgtagtattattagtgacggaacggagaggtcggnggtacggacgacgtaggacggtcggtacgggaccggaacggaaccgaccggtaccgtaccgtccg

SEQ ID NO: 441091 - DNA, 785 bp, Homo sapiens
  misc_feature: GZ8MTXP02FZQJE.19.3.A03.1.454.CMB.2.raw
  modified_base (263)..(263): a, c, t, g, unknown or other
  modified_base (366)..(366): a, c, t, g, unknown or other
tcagtactctcgtgcacgaccggtgctcgatttagagagcgtcacagagaggaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcgttggtccaggccgtgggggtccctgagctctcctgtacnggctcgtggttctctttagtagttagtggatgaacgtcgggccccgcgacggtccggtccgggggaaggggtccggaggtggggtcggaccaacgaagtaacnggacaaagagtaggaaactagaaagtaaaaactaggtacggggtactccggttagggtagggaaacggggacccggtaagtttacccgaacctaacgttaccctaacggaaacgtaaaccgggaaaacccgtaaaacccggttaaaacggttaaaaccctttttaacgtttaaggttttccgtaacgtaaacgtaaaacgttaaacgtaaaccgaacgggtacccgtaaagggaaccggaacggtacccgggaaacgggaaccgtaaccggggtacgttggttaggtttaaaagtttcggttaggtcggaacggtaaggggacgtagggtgggtacgtagggacgtaggtcgggtaccggttaacgggcggggaacccggaacggggtacccgtaaccgggtcccgtaaccggttcccg

SEQ ID NO: 441092 - DNA, 559 bp, Homo sapiens
  misc_feature: GZ8MTXP02J0LGW.19.3.A03.1.454.CMB.2.raw
  modified_base (214)..(214): a, c, t, g, unknown or other
  modified_base (301)..(301): a, c, t, g, unknown or other
  modified_base (349)..(349): a, c, t, g, unknown or other
  modified_base (424)..(424): a, c, t, g, unknown or other
  modified_base (429)..(429): a, c, t, g, unknown or other
  modified_base (444)..(444): a, c, t, g, unknown or other
tcagtactctcgtgcacgaccggtgctcgattttagagagcgtcacaggaggagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtgagtcngggggagcttggtcagcctgggggtccctgagactctcctgtacaggctctgggtctccttagtagttattggatgaactgggcccnccaggctccggggaaggccgagtggtggccaacataaatgacaaaganggaaactgagaaaaactataggggactgtgtgaaagggccgtaattcaaccatctccagagacaaccggttaaanaactntgtactagacaatanacagactagagagacgacgacgacgacgtagtagtagttattagtgacgtacggacgagacggagacggacgacgtagtacgtcggtcgggacgacggacgacgtacgaccgtcg

SEQ ID NO: 441093 - DNA, 644 bp, Homo sapiens
  misc_feature: GZ8MTXP02GGJRK.19.3.A03.1.454.CMB.2.raw
  modified_base (310)..(310): a, c, t, g, unknown or other
  modified_base (483)..(483): a, c, t, g, unknown or other
tcagtactctcgtgcacgaccggtgctcgatttagagagcgtcacaggagaggaagggggtctcagagaggagccttagccctggactccaaggcctttccacttggtgatcagcactgagcacagacgactcaccatggaattggggctgagctgggttttcctcgttggtattttagaggtgtccagtgtgaggtgcaccgtggtggagtcgtgggggagcttggtccagccgtgggggtccctgagactctcctgtacaggtctcgtgggttctcctttagtagttatggatgaacgtcgggccccncgaggccgtcgggggaaggggccggaggtggggtggaccaacataatggacaagagtaggaactagaaacgtaaaactgtacggggtactcgtggtggaacgggaccgtattccaacctactctacccaggaactaaaccaaacccgtaaagaaaccgtttaccttgtttacngaactaaatacgaaacagccgtagaaggtacggaccgaaggacaccggtagttgtagttaattaggttggtacgacggtaagggcgtaggcgggtctaggggacctaggtgggacgtcggtcggggaaccgtaaacggggccaaccggttccgaccgttcc

SEQ ID NO: 441094 - DNA, 530 bp, Homo sapiens
  misc_feature: GZ8MTXP01DVVB6.11.57.F02.1.454.CMB.2.raw
  modified_base (200)..(200): a, c, t, g, unknown or other
  modified_base (282)..(282): a, c, t, g, unknown or other
  modified_base (352)..(352): a, c, t, g, unknown or other
  modified_base (503)..(503): a, c, t, g, unknown or other
tcagcgagagataccacgaccggtgctcgatttagctcgatatagttgggtttggggaggaactgctcagttaggacccagagggaaccatggaagcccagctcagcttctcttcctcctgctacactggctccagataccaccggagaaattgtgttgacacagtctccggccacctgtctgcgtctcctggggaaacngtcacctctcctgcagggccagtcaaaatattaaacaactacttagcctggttccaacagaaacctggccaggctcccagcnctcatctatgatgcatttaggaggccatggcatcccaccaggttcagtgcagtggtctgggacagacttnattctcaaccatcccgcagcctagagcctgaagtatttgctagtttattactgtacaacagcgtagcagcacggcctccggcgacgttcggccgaagggaaccgaaggtaggaagtcaaaggcgaaacgttggtcgcgtcgcacgcttctnttcttctctccttccctccgttcgtcg

SEQ ID NO: 441095 - DNA, 510 bp, Homo sapiens
  misc_feature: GZ8MTXP01BN1CL.11.57.F02.1.454.CMB.2.raw
  modified_base (203)..(203): a, c, t, g, unknown or other
  modified_base (286)..(286): a, c, t, g, unknown or other
  modified_base (364)..(364): a, c, t, g, unknown or other
  modified_base (488)..(488): a, c, t, g, unknown or other
  modified_base (498)..(498): a, c, t, g, unknown or other
  modified_base (508)..(508): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggcncctcatcatgatgcatttaggaggccatggcatcccaccaggttcagtggcagtggtctgggacagacttcattctcncatcccgcagcctagagcctgaagattttgctagtttattactgtcaacagcgtagcagcgaggcctccggcgacgttcgccaagggaccaaggtcgaagtcaagcgaacgttgtgctgcaccnttctgtctcntcttcccgcntc

SEQ ID NO: 441096 - DNA, 547 bp, Homo sapiens
  misc_feature: GZ8MTXP01D1PLW.11.57.F02.1.454.CMB.2.raw
  modified_base (203)..(203): a, c, t, g, unknown or other
  modified_base (261)..(261): a, c, t, g, unknown or other
  modified_base (284)..(284): a, c, t, g, unknown or other
  modified_base (287)..(287): a, c, t, g, unknown or other
  modified_base (518)..(518): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggcaggctccaggcnctnatctatgatgcatttaggagggccatggcatcccaccaggttcagtggcagtggtctgggacagacttcattctcaaccatccgctacgcctagacgcctgaagtatttgctagtttattactgtacaacagcgtagcagcgacggtccgtccggcgtacggttccggaccgaaacggggaaccaagggtggaaagtaccgaaaggcgaaacgttggtaggctggcaccgnttctgtcttcactcttcccgtcaacttcg

SEQ ID NO: 441097 - DNA, 520 bp, Homo sapiens
  misc_feature: GZ8MTXP01CGOV8.11.57.F02.1.454.CMB.2.raw
  modified_base (200)..(200): a, c, t, g, unknown or other
  modified_base (257)..(257): a, c, t, g, unknown or other
  modified_base (281)..(281): a, c, t, g, unknown or other
  modified_base (285)..(285): a, c, t, g, unknown or other
  modified_base (383)..(383): a, c, t, g, unknown or other
tcagcgagagataccacgaccggtgctcgatttagctcgatatagttgggtttgggaggaactgctcagttaggaccagagggaaccatggaagcccagctcagcttctcttcctcctgctactctggctcccagataccaccggagaaattgtgttgacacagtctccggccaccctgtctgcgtctcctggggaaacngtcaccctctcctgcaggccagtcaaaatattaacaactacttagcctggttccaanagaaactggccaggctcccaggcncctnatctatgatgcatttaggagggccactggcatccccaccaggttcagtgcagtgggtctggggacagacttcattctcaaccatcccgcagcctagancctgaagatttgctagtttattactgtcaacagcgtagcagcaggcctccggcgacgttcggccaagggaccaaggtggaagtcgaaagcgaacttgtaggctgcaccgattctgtcttcactcttcccgtcaattc

SEQ ID NO: 441098 - DNA, 523 bp, Homo sapiens
  misc_feature: GZ8MTXP01CK3D0.11.57.F02.1.454.CMB.2.raw
  modified_base (262)..(262): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaanagaaacctggccaggctcccaggctcctcatctatgatgcatttaggaggccatggcatcccaccaggttcagtggcagtggtctgggacagacttcattctcaaccatccgcagcctagagcctgaagatttgctaagtttatactgtcaaacagcgtaagcagcaaggcctccggcgacgttcggccgaaaggacccaaggtggaagtcgaaagcgaacttggtggctgcaccgattctgtcttcatcttccgccaatc

SEQ ID NO: 441099 - DNA, 529 bp, Homo sapiens
  misc_feature: GZ8MTXP01DWVCP.11.57.F02.1.454.CMB.2.raw
  modified_base (286)..(286): a, c, t, g, unknown or other
  modified_base (365)..(365): a, c, t, g, unknown or other
  modified_base (491)..(491): a, c, t, g, unknown or other
  modified_base (504)..(504): a, c, t, g, unknown or other
  modified_base (526)..(526): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggcncctcatctatgatgcatttaggagggccatggcatccccaccaggttcagtgcagtgggtctgggacagacttcattcncaaccatcccgcagccctaggacgcctgaagtattttgctagtttattactgttacaacagcgtagcagcgaggcctccggcgacgttcggcgaagggaccaaggtggaagtcgaaaggcgaacgngtggctgcaccgnttctgtctcactcttccgcttntcg

SEQ ID NO: 441100 - DNA, 522 bp, Homo sapiens
  misc_feature: GZ8MTXP01EW1NK.11.57.F02.1.454.CMB.2.raw
  modified_base (264)..(264): a, c, t, g, unknown or other
  modified_base (266)..(266): a, c, t, g, unknown or other
  modified_base (286)..(286): a, c, t, g, unknown or other
  modified_base (496)..(496): a, c, t, g, unknown or other
  modified_base (522)..(522): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacagtcacctctcctgcagggccagtacaaaatattaaacaactacttagcctggttaccaananaaacctgcaggctccaggcncctcatctatgatgctatttaggagggccacgtggcactcccaccaggttcagtggcaggtgggtctgggacagacttcattcctcaacctatccgcacgcctagacgcctgaagtattttgctagtttattactgtacaacagcgtagcagcgacgccgtcggcgacgtcgacgaggacaaggtgagtcagcgaacttgtggctgcacnttctgtctctatccttccctcttgtn

SEQ ID NO: 441101 - DNA, 529 bp, Homo sapiens
  misc_feature: GZ8MTXP01DUXYZ.11.57.F02.1.454.CMB.2.raw
  modified_base (203)..(203): a, c, t, g, unknown or other
  modified_base (261)..(261): a, c, t, g, unknown or other
  modified_base (284)..(284): a, c, t, g, unknown or other
  modified_base (503)..(503): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctccagcncctcatctatgatgcatttaggagggccatggcatcccaccaggttcagtgcagtggtctgggacagacttcattctcaaccatcccgcagcctagagcctgaagtatttgctagtttattactgtacaacagcgtagcagcgacggcctccgggacgacggttccggccgaagggaccaagggtggaagtcgaagcgaacgttggtggcgtgcaccgnttctgtcttcactcttccgtcaatcg

SEQ ID NO: 441102 - DNA, 508 bp, Homo sapiens
  misc_feature: GZ8MTXP01A42O4.11.57.F02.1.454.CMB.2.raw
  modified_base (203)..(203): a, c, t, g, unknown or other
  modified_base (368)..(368): a, c, t, g, unknown or other
  modified_base (474)..(474): a, c, t, g, unknown or other
  modified_base (486)..(486): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccactggcatcccaccaggttcagtggcagtgggtctgggacagacttcattctcnccatccgcagcctagagcctgaagtatttgctagtttattactgtcaacagcgtagcagcgaggcctccggcgacgttcgcaaggaccaggtgagtcaagcgaacngtggctgcaccnttctgtctcatcttccgcaatc

SEQ ID NO: 441103 - DNA, 559 bp, Homo sapiens
  misc_feature: GZ8MTXP01CFA2Y.11.57.F02.1.454.CMB.2.raw
  modified_base (263)..(263): a, c, t, g, unknown or other
  modified_base (371)..(371): a, c, t, g, unknown or other
  modified_base (400)..(400): a, c, t, g, unknown or other
  modified_base (427)..(427): a, c, t, g, unknown or other
  modified_base (461)..(461): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactattagcctggttccaanagaaacctggccaggctcccaggctctcatctatgatgctatttaggagggccatggcatcccaccaggttcagtgcaggtggtctcgggacagtacttcattcctcnccatcccgcagcctagacgcctagaagtntttgactagtttattactgtacaacgngcgtagcagcgacggccgtccggacgtacgttcncggaccgaaacggggacctaaagggtcggaaagtccgaaaggcgaacgtcgttggctgaccaccttatcctagttccttacacttccttcccgctaac

SEQ ID NO: 441104 - DNA, 529 bp, Homo sapiens
  misc_feature: GZ8MTXP01BV0K8.11.57.F02.1.454.CMB.2.raw
  modified_base (203)..(203): a, c, t, g, unknown or other
  modified_base (286)..(286): a, c, t, g, unknown or other
  modified_base (364)..(364): a, c, t, g, unknown or other
  modified_base (504)..(504): a, c, t, g, unknown or other
  modified_base (515)..(515): a, c, t, g, unknown or other
  modified_base (526)..(526): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggcncctcatctatgatgcatttaggaggccatggcatcccaccaggttcagtggcaggtggtctgggacagacttcattcncaaccatcccgcagcctagacgcctagttaagatttgctagtttattactgtacaacagcgtagcagcgaggccgtccggcgacgttccggaccgaacgggaccgaaggtggaagtcgaagcgaacttggtgcgtgcacngttctgtctcntcttcccgtcngtc

SEQ ID NO: 441105 - DNA, 546 bp, Homo sapiens
  misc_feature: GZ8MTXP01CL2ZZ.11.57.F02.1.454.CMB.2.raw
  modified_base (204)..(204): a, c, t, g, unknown or other
  modified_base (261)..(261): a, c, t, g, unknown or other
  modified_base (282)..(282): a, c, t, g, unknown or other
  modified_base (284)..(284): a, c, t, g, unknown or other
  modified_base (512)..(512): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaaatattaacaactacttagcctgttccaanagaaacctgcaggctccagcncnatctatgatgcatttaggaggccatggcatcccaccaggttcagtgcagtggtctgggacagacttcattctcaacatcccgcacgcctagacgcctagagtatttgctagtttattactgtacaacgagcgtagctagcgacggtccgtccggcgtacggttccggaccgaagggaccgaagggtcggaaacgtcgaaggaacgtaacttgggtcgcgtagcaccgnttcgtgtcttcacttccttcccgtcttaagttcg

SEQ ID NO: 441106 - DNA, 678 bp, Homo sapiens
  misc_feature: GZ8MTXP01DDYY2.11.57.F02.1.454.CMB.2.raw
  modified_base (204)..(204): a, c, t, g, unknown or other
  modified_base (343)..(343): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcaggccagtacaaaatattaacaactacttagcctggtccaacagaacctgcaggctcccaggctcctcatctatgatgctatttaggagggccaactgggccaccctaccccacgttacgtacgnggtcgacgtagggtcgtgggtaaccgacgaacgtttctaacttcttaccacccaacgtccgcgaacgctaacgaggacctacgtaagtaattttgtacgagtttaatttactacggttactaaacaacgtcgtacgtacgacgacgaacgggtccggtaccccggtcgggtaccgttaccgggttaccggaaacgggtaaaccggaaaccgggttaggtaacggtaaccgtaacggaacggtaacccgtaacggttggggtcttacgacgaacccttacttacggttcgttcgttccttcgtacctttccccgttacctaaccttaacgttccgg

SEQ ID NO: 441107 - DNA, 540 bp, Homo sapiens
  misc_feature: GZ8MTXP01BS3W5.11.57.F02.1.454.CMB.2.raw
  modified_base (262)..(262): a, c, t, g, unknown or other
  modified_base (290)..(290): a, c, t, g, unknown or other
  modified_base (373)..(373): a, c, t, g, unknown or other
tcagcgagagataccacgaccggtgctcgatttagctcgatatagttgggtttgggggaggaactactcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctccncatctatgatgcatttaggaggccactggcatcccaccaggttcagtggcagtgggtctgggaccagacttcattctacaccntcccgcagccctagacgcctagaagtatttgctagtttattactgtacaacagcgtagcagcacggggcctcgggcgaccgttcggccgaacgggaccaagggtggaagtcgaagcgaacgtgttggcttgcaccattcttgtcttcaatccttccgctaattcgtg

SEQ ID NO: 441108 - DNA, 537 bp, Homo sapiens
  misc_feature: GZ8MTXP01EQIFX.11.57.F02.1.454.CMB.2.raw
  modified_base (204)..(204): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (366)..(366): a, c, t, g, unknown or other
  modified_base (508)..(508): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaaacaactacttagcctggttccaacagaaacctgcaggctccaggcnccnatctangatgctatttaggaggccatggcatccccaccaggttcagtggcaggtgggtctggggacagacttcattcncaacccatcccgcagcctagacgcctagaagtattttgctagtttattactgtacaacagcgtagcagcgacggcctccggcgacgttcggacgaacgggaccgaaggtaggaagtcgaagcgaacttggtggcgtgcaccnttctgtcttcgatccttccgccttaagtc

SEQ ID NO: 441109 - DNA, 570 bp, Homo sapiens
  misc_feature: GZ8MTXP01AVKI6.11.57.F02.1.454.CMB.2.raw
  modified_base (203)..(203): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccactggcatccccaccaggttcagtggcagtgggtctcggggacagtacttcattcctcaaccatcccgcacgcctagacgcctgaagtatttgctagtttattactgtacaacgagcgtaagcagcgaggtcccgtccggcgtaccggttccggccgaacggggacccgaagggtcggaaagtcgaaaggcgaaacgttggtcggcgtcggccacgttcttcgtgtcttcacgttccttcccgccttaacgttccg

SEQ ID NO: 441110 - DNA, 522 bp, Homo sapiens
  misc_feature: GZ8MTXP01AVUUK.11.57.F02.1.454.CMB.2.raw
  modified_base (368)..(368): a, c, t, g, unknown or other
  modified_base (483)..(483): a, c, t, g, unknown or other
  modified_base (496)..(496): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccactggcatcccacccaggttcagtggcagtgggtctgggacagtactcattctcnccatccgcagcctagagcctgaagtatttgctagtttatactgtcaacagcgtagcagcaggccgtccggcgacgttcggccgaaggaccaaggtgaagtcaagcgaaacgttgnggctggacaccgnttcctgtctcatcttccgcttaagtc

SEQ ID NO: 441111 - DNA, 522 bp, Homo sapiens
  misc_feature: GZ8MTXP01DBFTS.11.57.F02.1.454.CMB.2.raw
  modified_base (204)..(204): a, c, t, g, unknown or other
  modified_base (366)..(366): a, c, t, g, unknown or other
  modified_base (497)..(497): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttccaacagaaacctggccaggctcccaggctcctcatctatgatgcatttaggaggccatggcatcccaccagttcagtgcagtggtctgggacagacttcattctcncatccgcagcctagagcctgaagtatttgactagtttatactgtcaacgagcgtagcagcgacggcctccggcgtacgttcggccgaagggaccgaaggtggaagtcaaagcgaacgttgtgcgtgcacgnttctgtcttcatcttcccgcaatcg

SEQ ID NO: 441112 - DNA, 545 bp, Homo sapiens
  misc_feature: GZ8MTXP01EQ1RT.11.57.F02.1.454.CMB.2.raw
  modified_base (203)..(203): a, c, t, g, unknown or other
  modified_base (263)..(263): a, c, t, g, unknown or other
  modified_base (287)..(287): a, c, t, g, unknown or other
  modified_base (367)..(367): a, c, t, g, unknown or other
  modified_base (372)..(372): a, c, t, g, unknown or other
  modified_base (374)..(374): a, c, t, g, unknown or other
  modified_base (391)..(391): a, c, t, g, unknown or other
  modified_base (424)..(424): a, c, t, g, unknown or other
  modified_base (515)..(515): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttccaanagaaacctggccaggctccaggcncctcatctatgatgctatttaggaggccatggcactccccacccaggttcaggtggcaggtgggtctggggacagacttnattcncnccatccgcagcctagcncctgaatatttgctagtttattactgtacaacngcgtagcagcgacggtccctcggacgtacgtcggaccgaaagggaccaagggtaggaagtccgaaagcgtaaacgttggtaggctgcaccnttcgttgtcttcatccttcccgcttaatcg

SEQ ID NO: 441113 - DNA, 521 bp, Homo sapiens
  misc_feature: GZ8MTXP01DW1XD.11.57.F02.1.454.CMB.2.raw
  modified_base (203)..(203): a, c, t, g, unknown or other
  modified_base (262)..(262): a, c, t, g, unknown or other
  modified_base (282)..(282): a, c, t, g, unknown or other
  modified_base (356)..(356): a, c, t, g, unknown or other
  modified_base (361)..(361): a, c, t, g, unknown or other
  modified_base (500)..(500): a, c, t, g, unknown or other
  modified_base (519)..(519): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaaatattaaacaactacttagcctggttccaanagaaacctgcagctccagcnctcatctatgatgcatttaggagggccatggcatcccacccaggttcagtggcagtgggtctgggacagacttnattcncaaccatccgcagcctagagcctgaagtatttgctagtttattactgtacaacagcgtaagcagcgaacggcctccgggcgtacgttcggaccgaagggaaccaaggtggaagtcaagcgaacttgtaggctgcaccgnttctgtctcatcttccgcntc

SEQ ID NO: 441114 - DNA, 518 bp, Homo sapiens
  misc_feature: GZ8MTXP01ANOUM.11.57.F02.1.454.CMB.2.raw
  modified_base (286)..(286): a, c, t, g, unknown or other
  modified_base (491)..(491): a, c, t, g, unknown or other
  modified_base (501)..(501): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggcncctcatctatgatgcatttaggagggccactggcatcccacccaggttcagtggcagtgggtctgggacagcttcattctcaaccatccgcagcctagagcctgaagatttgctagtttattactgttcaacagcgtaagcagcaggcctccggcgacgttcggcaagggaccaggtgaagtcaagcgaattggtggctgcaccnttctgctttnactcttcccgccaattc

SEQ ID NO: 441115 - DNA, 690 bp, Homo sapiens
  misc_feature: GZ8MTXP01EKJRZ.11.57.F02.1.454.CMB.2.raw
  modified_base (261)..(261): a, c, t, g, unknown or other
  modified_base (274)..(274): a, c, t, g, unknown or other
  modified_base (280)..(280): a, c, t, g, unknown or other
  modified_base (282)..(282): a, c, t, g, unknown or other
  modified_base (651)..(651): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatataacaactacttagcctgtccaanagaacctgcagcnccagcncnatctatgatgctagtttagggacgggcccacgtcggacaactcccccaaccccgtagggtttcaaggttcggaccgtaagggttcgggggtccgttagggggaacctaaggtaccttttccaacttttccctaccaacccctaagttccccggacaacgccccgttaagggaacgtcccttaaggtaaacgttattttggacttaaaggtttttaattaaccgtgttacaaacgtagacgtaagcgaacgcggaacgggtcccgtcccgggacggtaccggttccggacccgaaaggggaacccgtaagggtacgggaaacgtccggaaaggcggtaaacgttgggtcgttcgtcggaccaacccgttnttctcgttcttcctactcccgttccccgcgttaacttcg

SEQ ID NO: 441116 - DNA, 540 bp, Homo sapiens
  misc_feature: GZ8MTXP01B596C.11.57.F02.1.454.CMB.2.raw
  modified_base (204)..(204): a, c, t, g, unknown or other
  modified_base (262)..(262): a, c, t, g, unknown or other
  modified_base (284)..(284): a, c, t, g, unknown or other
  modified_base (287)..(287): a, c, t, g, unknown or other
  modified_base (362)..(362): a, c, t, g, unknown or other
  modified_base (364)..(364): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctgcaggctccaggcnccnatctatgatgcatttaggaggccagtggcactcccaccaggttcagtgcagtggtctgggacagacttcatttcncnccatcccgcagcctagacgcctagaagtatttgctagtttattactgtacaacagcgtagcagcgacggcctcggcgacgtcgacgaaggaccgaaggtcggaagtacgaagaacgtaacgttgtacggcgtcgcaccgttattcgtgtcttctactccttcccgccttaacgtcg

SEQ ID NO: 441117 - DNA, 526 bp, Homo sapiens
  misc_feature: GZ8MTXP01A5M25.11.57.F02.1.454.CMB.2.raw
  modified_base (203)..(203): a, c, t, g, unknown or other
  modified_base (289)..(289): a, c, t, g, unknown or other
  modified_base (365)..(365): a, c, t, g, unknown or other
  modified_base (378)..(378): a, c, t, g, unknown or other
  modified_base (483)..(483): a, c, t, g, unknown or other
  modified_base (489)..(489): a, c, t, g, unknown or other
  modified_base (499)..(499): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctccncatctatgatgctagtttaggagggccagtggcatccccaccaggttcagtgcagtggctgggacagcttcattcncaaccatcccganacgccctaaggacgtccctagaagtattttgacttaagtttattaactgtacaacgtagcgtagcagcgacggccgtccggcgtacgtcgacgaggacaggtgancagcangtgctgcacnttctgtctcactcttccgcttaagtcg

SEQ ID NO: 441118 - DNA, 554 bp, Homo sapiens
  misc_feature: GZ8MTXP01CF1X7.11.57.F02.1.454.CMB.2.raw
  modified_base (358)..(358): a, c, t, g, unknown or other
  modified_base (371)..(371): a, c, t, g, unknown or other
  modified_base (382)..(382): a, c, t, g, unknown or other
  modified_base (402)..(402): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttccaacagaaacctggccaggctcccaggctcctcatctatgatgctagtttaggagggccagtggcatcccatccaggttcagtgcagtggtcctgggacngtacttcaattcncaccatcccgnagcctagacgcctagaagtntttgactagttttattactgtacaacgagcgtaagcaaggcacggccctccggcgtaccggttcggaccgaaaggggaccgtaaagggtacggaacgtcgaaacggcgaacgtggttggcctgaccgccatctgtctcacttcctcccgctc

SEQ ID NO: 441119 - DNA, 527 bp, Homo sapiens
  misc_feature: GZ8MTXP01ADULG.11.57.F02.1.454.CMB.2.raw
  modified_base (309)..(309): a, c, t, g, unknown or other
  modified_base (388)..(388): a, c, t, g, unknown or other
  modified_base (500)..(500): a, c, t, g, unknown or other
  modified_base (510)..(510): a, c, t, g, unknown or other
  modified_base (520)..(520): a, c, t, g, unknown or other
  modified_base (524)..(524): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggtccaacagaaacctggccaggctcccaggctcctcatctatgatgcatttaggngggccactggcatccccaccgagttcagtgcaggtggtctgggacagacttcattctcaaccatcccgcagcctagacncctagagtatttgactagtttattactgtcaacagcgtagcgagcgaggcctccgggcgtacgtcggacaagggaccaaggtggaagtcaagcgaacgttgtggctgcaccnttctgtctcntccgttcccncttntcg

SEQ ID NO: 441120 - DNA, 524 bp, Homo sapiens
  misc_feature: GZ8MTXP01AYGNN.11.57.F02.1.454.CMB.2.raw
  modified_base (295)..(295): a, c, t, g, unknown or other
  modified_base (347)..(347): a, c, t, g, unknown or other
  modified_base (400)..(400): a, c, t, g, unknown or other
  modified_base (497)..(497): a, c, t, g, unknown or other
  modified_base (506)..(506): a, c, t, g, unknown or other
tcagcgagagataccacgaccggtgctcgatttagctcgatatagttgggtttggggcagggtgtacacctgtggttctcgggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagtgaacttgacctnagggtctcgtggctcacgtccaccaccacgcatgtgaccctcgaggggtccncaggctcccgagggtagggctggaatggatttcatacattagcagtagtggtncgaccatatactacgcagactctgtgaacgggccgattcgatcatctaccagagacaatcgacaacaactcaactgttatcttaggaaactcaacgngacctgagngtcgaggactcggctaag

SEQ ID NO: 441121 - DNA, 593 bp, Homo sapiens
  misc_feature: GZ8MTXP01CLS7G.11.57.F02.1.454.CMB.2.raw
  modified_base (204)..(204): a, c, t, g, unknown or other
  modified_base (292)..(292): a, c, t, g, unknown or other
  modified_base (374)..(374): a, c, t, g, unknown or other
  modified_base (376)..(376): a, c, t, g, unknown or other
  modified_base (428)..(428): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaaatattaacaactacttagcctggttccaacagaaacctggccaggctcccagctcctnatctatgatgctagtttaggaggccactggcactccccaccaggttcaggtggctagtgggtctcgggacagacttcattcncncatccgcacgcctagcgcctagtaatatttgctagtttattactgtacaacngcgtagacagcgacggcccgttccggacggtaccgttccggaccgaaacggggaacccgaaggggtacggaaacgtcgaaaggcggtaaacgttggtacggcgtacggccaacccgattcgtaacgttccttcctacttcccgttccccgtcccgttgttaaccg

SEQ ID NO: 441122 - DNA, 614 bp, Homo sapiens
  misc_feature: GZ8MTXP01EDYJS.11.57.F02.1.454.CMB.2.raw
  modified_base (263)..(263): a, c, t, g, unknown or other
  modified_base (283)..(283): a, c, t, g, unknown or other
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccacctgtctgcgtctccgtggggaaacagtcaccctctcctgcagggccagtacaaaatattaacaactacttagcctggttccaaanagaaacctgcagctccagcncnatcatgatgctagtttaggagggccagtcggactactccccaccgtaggttcaggtggcaggtggggtctggggacagacttcattcctcaaccatcccgcacgtccctaaggacgtcctagtaagttattttgacttaagttttaatttactgtactaacgagtcgtaagacagcggaacgggtcccgtaccgggccggtacgttccgggaccgaaaggggaaccgtaaggggtaggaaacggtacgaaaggccggtaaacgttggtacggcgtcggaccaaccgttgttctaagttccttctacttccttcccgtccttaagttccg

SEQ ID NO: 441123 - DNA, 584 bp, Homo sapiens
  misc_feature: GZ8MTXP01EK297.11.57.F02.1.454.CMB.2.raw
  modified_base (524)..(524): a, c, t, g, unknown or other
tcagcgagagataccacgaccggtgctcgatttagctcgatatagttgggtttggggctctcagagaggtgccttggtcctggattccaaggcatttccacttggtgatcagcactgaacacagaggactcaccatggagttggggctgtgctgggtttccttgttgctatttagaaggtgtccagtgcgaggtgcaagtggtgcagtctgggggagcttagtccaggccggggggtcctgagactctcctgtctagtctctggattcgcctcagtgactatgccatgaagtgggtccgccgagctacgagggtagggctaggagtggtatttcatactagttacgcgtagtaggtggtcgaaccgaacctaataataacctacgacgaacgtacttcgtaggtagggaaacgggtccgttattacactactaactctaaccgagaacgaacaagtagaccaaacaactacgtactagtatcgtaagaactaacacagtacctgaagaagtcgaggacacggtntagttaattgtttacgttggcgtaacgacgacccgttaccccgtgggttcgtaacccggg

SEQ ID NO: 441124 - DNA, 527 bp, Homo sapiens
  misc_feature: GZ8MTXP01ED47J.11.57.F02.1.454.CMB.2.raw
  modified_base (204)..(204): a, c, t, g, unknown or other
  modified_base (370)..(370): a, c, t, g, unknown or other
  modified_base (499)..(499): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccactggcatccccaccaggttcagtggcagtgggtctgggacagacttcattctcnccatcccgcagccctagagccctgaagtatttgctagtttattactgtcaacagcgtagcagcgaggcctccggcgacgttcggccgaagggaccaaggtggaagtcaagcgaacttgtggctgcaccnttctgtcttcactcttcccgtccaatcg

SEQ ID NO: 441125 - DNA, 572 bp, Homo sapiens
  misc_feature: GZ8MTXP01AXTRR.11.57.F02.1.454.CMB.2.raw
  modified_base (203)..(203): a, c, t, g, unknown or other
  modified_base (258)..(258): a, c, t, g, unknown or other
  modified_base (279)..(279): a, c, t, g, unknown or other
  modified_base (372)..(372): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacngtcaccctctcctgcagggccagtcaaaatattaacaactacttagctgtccaanagaacctgccaggctccagcnctcatctatgatgactagtttaggacgggccacgtggacactccccacccgtaggttccaggtgcaggtgggtctgggacagacttcattccncnccatcccgcacgtcctagacgtcctagtaacgtatttcgctaagtttattactgtacaacagcgtagcagcgacggccgtccggacgtaccggttcggaccgtaacgggaaccgtaggtaggaacgtacgaaaggcgaacgttgtcggcgtcgccacacgttcgtaacgttcttcacttccttcccgtccttcgttcg

SEQ ID NO: 441126 - DNA, 523 bp, Homo sapiens
  misc_feature: GZ8MTXP01DL6QE.11.57.F02.1.454.CMB.2.raw
  modified_base (286)..(286): a, c, t, g, unknown or other
  modified_base (366)..(366): a, c, t, g, unknown or other
  modified_base (418)..(418): a, c, t, g, unknown or other
  modified_base (499)..(499): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttggcctggttccaacagaaacctggccaggctcccaggcncctcatctatgatgcatttaggagggccatggcatcccaccaggtttcagtgcagtggtctgggacagacttcattctcnccatcccgcagcctagagcctgaagtattttgctagtttattactgtcaacngcgtagcagcgacggcctccggcgtaccgttcggccgaagggaaccaaggtggaagtcaagcgaaacttgtgcgtgcaccnttctgtcttcatcttcccgcaatc

SEQ ID NO: 441127 - DNA, 528 bp, Homo sapiens
  misc_feature: GZ8MTXP01DLGNN.11.57.F02.1.454.CMB.2.raw
  modified_base (499)..(499): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccatggcatcccaccaggttcagtggcagtgggtctgggacagacttcattctcaaccatcccgcagcctagacgcctagaagtattttgctagtttattactgtcaacagcgtagcagcgaggcctccggcgacgttcgcgaagggaccaaggtggaagtcaagcgaacttggtggcgtgcaccgnttctgtcttcatccttcccgcttaattcg

SEQ ID NO: 441128 - DNA, 589 bp, Homo sapiens
  misc_feature: GZ8MTXP01C0KJF.11.57.F02.1.454.CMB.2.raw
  modified_base (204)..(204): a, c, t, g, unknown or other
  modified_base (282)..(282): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaacaactacttagcctggtccaacagaacctgcaggctccagcnctcatctatgatgcagtttaggagggccacgtggcactccccacccgtaggtttcaggtggcaggtggtctcggggacagtacttcattctcaacctatcccgcacgcctagacgcctagtaagtatttgctaagtttattactgtactaacgagtacgtagacaggcgacggcccgttccgggaccgtacggtccggaccgaaggggaacccgaagggtaggaaagtcgaaaggtcgaacgttggtacggcgtacgacaccttgttccttgtaccttctacttcccttcccgtccttaacgttccg

SEQ ID NO: 441129 - DNA, 517 bp, Homo sapiens
  misc_feature: GZ8MTXP01CJ9O4.11.57.F02.1.454.CMB.2.raw
  modified_base (203)..(203): a, c, t, g, unknown or other
  modified_base (327)..(327): a, c, t, g, unknown or other
  modified_base (365)..(365): a, c, t, g, unknown or other
  modified_base (374)..(374): a, c, t, g, unknown or other
  modified_base (383)..(383): a, c, t, g, unknown or other
  modified_base (417)..(417): a, c, t, g, unknown or other
  modified_base (478)..(478): a, c, t, g, unknown or other
  modified_base (491)..(491): a, c, t, g, unknown or other
  modified_base (512)..(512): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtcaaaatattaacaactacttagcctggttccaacagaaacctggccaggctcccaggctcctcatctatgatgcatttaggagggccatggcatcccaccnggttcagtggcagtggtctgggacagacttcattctcnccatcccgnagcctaganccctgaagattttgctagtttattactgtcaacngctagcagcgaggcctccggcgacgttccggcgaagggaccaaggtggaagtcagcgaacnggtggctgcaccnttctgtcttcatccttccgcngttcg

SEQ ID NO: 441130 - DNA, 537 bp, Homo sapiens
  misc_feature: GZ8MTXP01AWWLG.11.57.F02.1.454.CMB.2.raw
  modified_base (290)..(290): a, c, t, g, unknown or other
  modified_base (327)..(327): a, c, t, g, unknown or other
  modified_base (359)..(359): a, c, t, g, unknown or other
  modified_base (361)..(361): a, c, t, g, unknown or other
  modified_base (510)..(510): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctnatctatgatgcatttaggaggccatggcatcccaccnggttcagtgcagtggctgggacagctcattcncnccatcccgcagcctagagtccctagaagtattttgctagtttattacgtgtacaactagcgtaggcaagcgaggccctccggcgtaccggttcggaccgtaaaggggaccaagggtggaaagtcgaagcgaacttggtgcgtgcaccgnttctgtcttcatcttacccgcaagtcg

SEQ ID NO: 441131 - DNA, 541 bp, Homo sapiens
  misc_feature: GZ8MTXP01AWJZT.11.57.F02.1.454.CMB.2.raw
  modified_base (204)..(204): a, c, t, g, unknown or other
  modified_base (260)..(260): a, c, t, g, unknown or other
  modified_base (281)..(281): a, c, t, g, unknown or other
  modified_base (284)..(284): a, c, t, g, unknown or other
  modified_base (515)..(515): a, c, t, g, unknown or other
  modified_base (521)..(521): a, c, t, g, unknown or other
  modified_base (526)..(526): a, c, t, g, unknown or other
  modified_base (534)..(534): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtcaccctctcctgcagggccagtacaaaatataacaactacttagcctgtccaanagaaacctgcaggctccagcnctnatctatgatgctagtttaggaggccatggcatccccaccagttcagtggcaggtggtctgggacagacttcattcctcaacatccgcacgcctagacgtcctagaagtatttgctagtttattactgtacaacagcgtagcagcgacggccgtccggcgtacgttccggaccgaaagggaaccgaagggtaggaacgtcgaaaggcgaaagttggtcggctgacaccgttnttcgtntctcntccttccnccaatcg

SEQ ID NO: 441132 - DNA, 557 bp, Homo sapiens
  misc_feature: GZ8MTXP01EZURR.11.57.F02.1.454.CMB.2.raw
  modified_base (204)..(204): a, c, t, g, unknown or other
  modified_base (372)..(372): a, c, t, g, unknown or other
  modified_base (529)..(529): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaaacaactacttagcctggttccaaacagaaacctggccaggctcccaggctcctcatctatgatgcatttaggagggccactggcatccccaccaggtttcagtgcagtgggtctgggacagacttcatttccncaaccatcccgcagccctagacgcctgaagtattttgctagtttattactagttacaacagcgtaagcagcgacgggtccctccgggcgacgttcggaccgaaagggacccgaagggtggaaagtcgaaggcgaaacgttggtacggcgtggcacgnttctgtcttcactcttccgcttaagtcg

SEQ ID NO: 441133 - DNA, 592 bp, Homo sapiens
  misc_feature: GZ8MTXP01ERNH0.11.57.F02.1.454.CMB.2.raw
  modified_base (288)..(288): a, c, t, g, unknown or other
  modified_base (366)..(366): a, c, t, g, unknown or other
  modified_base (372)..(372): a, c, t, g, unknown or other
  modified_base (553)..(553): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctccaggcncctcatctatgatgcatttaggagggccagtgcactccccacctaggtcagtggcaggtggtctggggacagtacttnacttcncaaccatccgcagcctagacgcctagaacgtattttgacttaagtttattacgtgttacaactacgcgtaagcgagacgaacgggtccccgttaccggacggtaccggtccggaccgaaacgggaacccgaaagggtaggaaacgtacgaaggcgaaacgttggtcggcgtcgcaccgttnttaccgttgtccttcacttcccttacccgtcttaactcg

SEQ ID NO: 441134 - DNA, 800 bp, Homo sapiens
  misc_feature: GZ8MTXP01CKM92.11.57.F02.1.454.CMB.2.raw
  modified_base (205)..(205): a, c, t, g, unknown or other
  modified_base (263)..(263): a, c, t, g, unknown or other
  modified_base (291)..(291): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtcaccctctcctgcaggccagtacaaaatattaaacaactactagcctggtaccaanagaaacctggccaggctcccgagctccncatctatgatgctaagtttaggacgggccacgtggacctaactcccccaacccgtagggtttaccaagggttcggaccgtaagggttcgggggtaccttacgggggaccaaggtacctttcaactttccctaccaacccgtaactcccgacgtaacgtacctaacggacgcccttaagtaaacgttagttttacggacttaacggtttttaacttaaccgttacggtaacctaaaccgaggtaccggttaagtaccgagggtaccgggaaacccggggttccccgttaccggggacccgggtaaacccgggtttacccggaacccgggtaaaacgggggaaaccccggtaaaagggggtcgggaaaaccggtaccgaaaacgggtaaccggtaaacggtttgggtaacgggcccgttacgggaacccgttaaacccgttcgtttccggtttaacgttccctttaacctaaccggtttcccctttaccccggaaccttaacgtttcccgg

SEQ ID NO: 441135 - DNA, 576 bp, Homo sapiens
  misc_feature: GZ8MTXP01EKE80.11.57.F02.1.454.CMB.2.raw
  modified_base (204)..(204): a, c, t, g, unknown or other
  modified_base (259)..(259): a, c, t, g, unknown or other
  modified_base (278)..(278): a, c, t, g, unknown or other
  modified_base (280)..(280): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtggggaaacngtcaccctctcctgcagggccagtacaaaatataacaactacttagctgtccaanagaacctgcagctccagcncnatctatgatgctagtttaggagggccacgtggcactccccaccgtaggtttcagtggcaggtgggtctgggacagtacttcattcctcaaccatcccgacagcctagacgcctagaagtatttgcttaagtttattactgtacaacgagcgtagacagcggacggccgtccgggcgtacgttccggaccgaaagggaacccgaagggtaggaacgtacgaaacgaacggtaacgttggtacggcgtcggaccacttagttctaagtcttcacttcccttacccgtccttaattccg

SEQ ID NO: 441136 - DNA, 544 bp, Homo sapiens
  misc_feature: GZ8MTXP01CU1R4.11.57.F02.1.454.CMB.2.raw
  modified_base (204)..(204): a, c, t, g, unknown or other
  modified_base (263)..(263): a, c, t, g, unknown or other
  modified_base (370)..(370): a, c, t, g, unknown or other
  modified_base (372)..(372): a, c, t, g, unknown or other
  modified_base (381)..(381): a, c, t, g, unknown or other
  modified_base (515)..(515): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaaacaactacttagcctggttccaanagaaacctggccaggctcccaggctcctcatctatgatgctagtttaggagggccatggcactccccaccaggttcagtggcaggtggtctgggacagcttcattcncnccatcccgnacgcctagacgcctgaagtattttgctagtttattactgttacaacagcgtagcagcgacggccgtccggacgaccgttcggaccgaagggaccgaagggtggaagtcgaaagcgaacttggtggcgtgcaccnttctgtcttcactccttcccgcttaatcg

SEQ ID NO: 441137 - DNA, 611 bp, Homo sapiens
  misc_feature: GZ8MTXP01C97LL.11.57.F02.1.454.CMB.2.raw
  modified_base (204)..(204): a, c, t, g, unknown or other
  modified_base (286)..(286): a, c, t, g, unknown or other
  modified_base (288)..(288): a, c, t, g, unknown or other
  modified_base (356)..(356): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtccaccctctcctgcagggccagtacaaaatattaaacaactacttagcctggttccaacagaaacctgcaggctccagcncncatctatgatgcatttaggaggccactggcatccccaccaggtttcaggtgcaggtggtctggggacngtacttcattctacaaccatcccgacacgccctaggacgcctagtaaagtacttttgacttaagttttataacttgttacaactagaccgtagacagacgacgggtcccgtccgggaccgaccggttaccggacccgaaacgggaaccgaagggtacggaaacgtacgaaaggaacgtaacgttggtacggcgtacgaccttacgttacttcgttcgttaccttctacttcccttaccccgtccttaacgttccg

SEQ ID NO: 441138 - DNA, 540 bp, Homo sapiens
  misc_feature: GZ8MTXP01BXH9R.11.57.F02.1.454.CMB.2.raw
  modified_base (204)..(204): a, c, t, g, unknown or other
  modified_base (262)..(262): a, c, t, g, unknown or other
  modified_base (369)..(369): a, c, t, g, unknown or other
  modified_base (371)..(371): a, c, t, g, unknown or other
  modified_base (379)..(379): a, c, t, g, unknown or other
  modified_base (510)..(510): a, c, t, g, unknown or other
  modified_base (521)..(521): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctctcatctatgatgctatttaggaggccagtggcatccccaccaggttcagtgcaggtgggtctgggacagacttcatttccncncatcccgnacgcctagacgcctagaagtatttgctagtttatactgtacaacagcgtagcagcgacggccgttccggcgtacgttcggaccgaagggaccaagggtaggaagtcaaggcgaacgttggtcggctgcacnttctgtcttcnctcttacccgcttaattcg

SEQ ID NO: 441139 - DNA, 558 bp, Homo sapiens
  misc_feature: GZ8MTXP01CVWRW.11.57.F02.1.454.CMB.2.raw
  modified_base (204)..(204): a, c, t, g, unknown or other
  modified_base (260)..(260): a, c, t, g, unknown or other
  modified_base (279)..(279): a, c, t, g, unknown or other
  modified_base (282)..(282): a, c, t, g, unknown or other
  modified_base (365)..(365): a, c, t, g, unknown or other
  modified_base (519)..(519): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcaggccagtacaaaatataacaactacttagcctgtaccaanagaacctgcagctccagcnctnatctatgatgctagtttaggaggccacgtggcactccccacctaggttcagtggcaggtggtctgggacagtcttcattctcnccatccgacacgcctagacgcctagtaagtatttgacttagtttattactagtacaacgagacgtagacagcgacggtccgtccggacgtacggtccgacgaaggaccgaggtaggaagtcgaagaacgaacgttggtacgcgtagcaccgttnttccgtgtccttctacgtccttacccgtccttaacttcg

SEQ ID NO: 441140 - DNA, 529 bp, Homo sapiens
  misc_feature: GZ8MTXP01D4A81.11.57.F02.1.454.CMB.2.raw
  modified_base (204)..(204): a, c, t, g, unknown or other
  modified_base (262)..(262): a, c, t, g, unknown or other
  modified_base (283)..(283): a, c, t, g, unknown or other
  modified_base (287)..(287): a, c, t, g, unknown or other
  modified_base (366)..(366): a, c, t, g, unknown or other
  modified_base (393)..(393): a, c, t, g, unknown or other
  modified_base (499)..(499): a, c, t, g, unknown or other
  modified_base (526)..(526): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctgcaggctccagcncctnatctatgatgcatttaggagggccagtggcatccccaccaggttcagtgcaggtggtctgggacagacttcattccacnccatccgcagcctagagcctagaagtntttgctagtttattactgtacaagagcgtagcagcgacggccgtccggcgacggtcgccgaaagggaccaagggtggaagtcgaagcgaagttggtgcgtgcaccngttctgtcttcactccttcccgccttntcg

SEQ ID NO: 441141 - DNA, 579 bp, Homo sapiens
  misc_feature: GZ8MTXP01D58OT.11.57.F02.1.454.CMB.2.raw
  modified_base (242)..(242): a, c, t, g, unknown or other
  modified_base (291)..(291): a, c, t, g, unknown or other
  modified_base (314)..(314): a, c, t, g, unknown or other
  modified_base (354)..(354): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggcgtttgttggagaccttgcacttgtactccttgccattcagccagtcctggtgcaggacggtgaggacgctgaccacacggtacgtgctgttgtactgcctcctcccgnggtctttgcttggctattatgccacctccacgcccgtcacgtaccagtnaacttgacctcgagggtcttcgngctcacctccaccaccacgcatgcacctcgaggggtcccncgaggcctcccgagggtagggctggaatggatttcaatacatttagctaggtagtggtcacgaccatactactacgcagtactcgtggtagaacgggacctatttaccgaattctaacttccctacccgaaagaagaactaagtacggtacaaacaactactaactattatacttagaaactaacaacgcacgaagagaacgacgacggacgtaacgttcgtaag

SEQ ID NO: 441142 - DNA, 520 bp, Homo sapiens
  misc_feature: GZ8MTXP01BW2BU.11.57.F02.1.454.CMB.2.raw
  modified_base (364)..(364): a, c, t, g, unknown or other
  modified_base (446)..(446): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaggtgtccagtgcgaggtgcaagtggtgcagtcgtgggggagcttagtccgaggcccggggggtccctgagactctcctgtctagtctctggattcgcctcagtgactatgccatgaagtgggtccgcaggctccgaggtaaggggctggaatggatttcatacattagcagtagtggtgacgacntatactacgcagactctgtgaggccgattcatcatctccagagacaatggacaacaactacactgtatctaggaatacaacngcctggagaagtcgaggacacggtctagttattattagtgtgaacgtagcgcccccgtaagggttcgtaaccgg

SEQ ID NO: 441143 - DNA, 531 bp, Homo sapiens
  misc_feature: GZ8MTXP01BY3XZ.11.57.F02.1.454.CMB.2.raw
  modified_base (203)..(203): a, c, t, g, unknown or other
  modified_base (234)..(234): a, c, t, g, unknown or other
  modified_base (261)..(261): a, c, t, g, unknown or other
  modified_base (309)..(309): a, c, t, g, unknown or other
  modified_base (505)..(505): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatnttaacaactacttagcctggttccaanagaaacctggccaggctcccaggctcctcatctatgatgcatttaggnggccatggcatcccaccaggttcagtgcagtggctgggacagacttcattcctcaaccatcccgcagccctagacgccctgaacgtatttgctagtttattactgtcaacagcgtagcagcgacggcctccggcgacgttccggaccgaagggaccaagggtggaaagtcgaagcgaacttgtaggctggcaccgnttctgtctcactcttcccgcaactcg

SEQ ID NO: 441144 - DNA, 522 bp, Homo sapiens
  misc_feature: GZ8MTXP01EI6G0.11.57.F02.1.454.CMB.2.raw
  modified_base (477)..(477): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggcccgggggggtccctgagactctcctgtctagtctctggattcgcctcagtgactatgccatgaagtgggtcccgccaggctccgaggtaagggggctaggaatggatttcatacattagcagtagtggtgacgacaatatactacgcagactcgtgtgaaggccgatcatcatctccagagacaatgacaacgaactcactagtatctaggaatacaacacgcctgacgaagtcgaggacacggntgttattattagtgtgcgtagacgccccgtaacggttcgtaaccg

SEQ ID NO: 441145 - DNA, 537 bp, Homo sapiens
  misc_feature: GZ8MTXP01DHAX9.11.57.F02.1.454.CMB.2.raw
  modified_base (371)..(371): a, c, t, g, unknown or other
  modified_base (409)..(409): a, c, t, g, unknown or other
  modified_base (502)..(502): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccgaggccgggggggtccctgagactctcctgtctagtctctggattcgccttcagtgactatgccatgaagtgggtccgccgaggctccgagggtaagggggctgggaatggatttcatacattagcagtagtggtgacgaccntatactacgcagactctgtgaagggccattcatcatcncagagacaaatggacaaacgaacttcacttacgtaatccgttaggaaaacttcaaactgcctagacgaagtacgaggaccaggctagttattnttatgtgcgaggaccgcccctaaggttcgaaccgg

SEQ ID NO: 441146 - DNA, 740 bp, Homo sapiens
  misc_feature: GZ8MTXP01C7T23.11.57.F02.1.454.CMB.2.raw
  modified_base (264)..(264): a, c, t, g, unknown or other
  modified_base (288)..(288): a, c, t, g, unknown or other
  modified_base (454)..(454): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcaggccagtacaaaatattaaacaactactagcctggttaccaanagaaacctggccaggctcccagcnctcatctatgatgactagtttaggacgggcccagtcggaccactcccccgacctaagggtttccaggttcggctaggttggggtctacggggacagtaccttcactttcctaccaaccctacgtcccgacaacgtacccttaaggcgtacccgtagtaaacggttnttttacggacttaagtttttaacttaacgttacggttacaaacgtacggtacgtaacggaccgaacggaccggtaaaccggggtccccgttcccgggtacccggtaccgggtttacccgggacccggtaaaacggggaaacccgtaaagggggtacgggtaaaacgtacgaaacgggaacggtaaaccgttgggttacggaccgttacggacccttaaccttacgtttcttaacggttccctttaactaaccggttcccttaccccgtcccgttaactttaaccgg

SEQ ID NO: 441147 - DNA, 603 bp, Homo sapiens
  misc_feature: GZ8MTXP01CID82.11.57.F02.1.454.CMB.2.raw
  modified_base (204)..(204): a, c, t, g, unknown or other
  modified_base (263)..(263): a, c, t, g, unknown or other
  modified_base (284)..(284): a, c, t, g, unknown or other
  modified_base (287)..(287): a, c, t, g, unknown or other
  modified_base (439)..(439): a, c, t, g, unknown or other
  modified_base (557)..(557): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctggttccaanagaaacctgcaggctccagcnctnatctatgatgctagtttagggagggccagtggaccatccccaccgtaggtttcaggtggcaggtggtctcggggacaggtacttcattcctcaaccatcccgcacgcctagacgtcctagtaagtattttgcttagtttattactgtacaanacgacgtagctaagcgacggccgttccgggacgtaccggtcggaccgaagggaccgaaggggtacggaaagtcgaaacggaaccggtaagttggtacgggctacggcttaacccgttnttccgtgtttcttaactacgttcccttacccgccgttaactttccg

SEQ ID NO: 441148 - DNA, 563 bp, Homo sapiens
  misc_feature: GZ8MTXP01EYDEB.11.57.F02.1.454.CMB.2.raw
  modified_base (286)..(286): a, c, t, g, unknown or other
  modified_base (308)..(308): a, c, t, g, unknown or other
  modified_base (367)..(367): a, c, t, g, unknown or other
  modified_base (369)..(369): a, c, t, g, unknown or other
  modified_base (385)..(385): a, c, t, g, unknown or other
  modified_base (531)..(531): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctgccaggctcccaggcnctcatctatgatgcatttaggngggccactggcactccccaccaggttcagtgcagtggtctggggacagacttcatttcncnccatccgcagcctagngcctgaagtatttgactagtttattactgttacaacagcgtagacacgcgtacggccgtacccggcgtacggttccggaccgtaaacggggaaccgaagggtaggaaacggtccgaaaggaacgaaacgttggtggcgtggcacgnttctgtcttctacttccttcccgccttaatcg

SEQ ID NO: 441149 - DNA, 590 bp, Homo sapiens
  misc_feature: GZ8MTXP01BQ11R.11.57.F02.1.454.CMB.2.raw
  modified_base (206)..(206): a, c, t, g, unknown or other
  modified_base (265)..(265): a, c, t, g, unknown or other
  modified_base (287)..(287): a, c, t, g, unknown or other
  modified_base (291)..(291): a, c, t, g, unknown or other
  modified_base (405)..(405): a, c, t, g, unknown or other
  modified_base (430)..(430): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtaggggaaacngtccaccctctcctgcagggccagtacaaaatattaacaactacttagcctggtccaanagaacctgccaggctcccagcncctnatctatgatgctagtttaggaggcccatggaccacttcccccaaccgtagggtttccaggttcggacaggtgggtctaggggacaggtacttcactttcaccaacctatcccgnaacgccctagactcctagtaacgtntttgacttagtttatacgtgtacaagagcgtaagcgagcggacggccgtccggacgtacgtcggaccgaagggaaccgaagggtacgaagtccgaaggccgaaagttggtacgcgtcacaccttgttcttaaggtcttctactccttccgcttaacgtcg

SEQ ID NO: 441150 - DNA, 526 bp, Homo sapiens
  misc_feature: GZ8MTXP01A22G7.11.57.F02.1.454.CMB.2.raw
  modified_base (204)..(204): a, c, t, g, unknown or other
  modified_base (369)..(369): a, c, t, g, unknown or other
  modified_base (499)..(499): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaaacaactacttagcctggttccaacagaaacctggccaggctcccaggctcctcatctatgatgcatttaggagggccatggcatccccaccaggttcagtgcagtgggtctgggacagacttcattctcnccatccgcagccctagagcctgaatatttgctagtttatactgtcaacgtgcgtagcagcgaggcctccggcgacgttcggccaagggaccaaggtgaacgtcgaagcgaacttggtcggctggcaccgnttctgtcttcactccttccgcaactcg

SEQ ID NO: 441151 - DNA, 583 bp, Homo sapiens
  misc_feature: GZ8MTXP01B0Y01.11.57.F02.1.454.CMB.2.raw
  modified_base (261)..(261): a, c, t, g, unknown or other
  modified_base (370)..(370): a, c, t, g, unknown or other
  modified_base (544)..(544): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtacaaaatattaaacaactatagctggtccaanagaaacctgcagctccagctctcatctatgatgctagtttaggagggcccaatggccaatccccaaccgaggttccagtggcaggtgggtctgggacagacttcattcncaaccatcccgcaacgcctaagacgcctagaaagtattttggacttaagtttattaactgtacaacgagcgtaagcagcgacggccgtaccggcgaacgttcggaccgaagggaaccgaagggtaggaaacgtcgaaaggcggtaaacgttggtcgggcttacgccttacccgnttctaacgttcttccaattcccttcccgaacttaactcg

SEQ ID NO: 441152 - DNA, 764 bp, Homo sapiens
  misc_feature: GZ8MTXP01C26KD.11.57.F02.1.454.CMB.2.raw
  modified_base (265)..(265): a, c, t, g, unknown or other
  modified_base (289)..(289): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatattaaacaactacttagcctggtaccaanagaaacctggccaggctcccagcncctcatctatgatgctaagtttagggacgggccacgtcggaccactccccacccgtagggtttcacggttggcgtaggtggggtcgtcggggaacaggtacttcactttaccttaccaacctactcccgactaaccggacctagggacgtccgttagtaaacgttaagtttttcggacttaaggtttttaacttaacgtttacggttaacaaaccgtaggacgttaacggacgtaacggacgggtaaccggggtccccggttacccgggacccgggtaaacccggtttcccgggggaacccgtaaaacgggggaacccggtaaagggggttacggggtaaaacggtacggaaacgggaacggtaaaccggttggggtacggccgttacgggaccttaacccgttacgttcccgtttaacggtttaccctttccgttaaccgttcccctttaccccggtaaccgttaactttccgg

SEQ ID NO: 441153 - DNA, 577 bp, Homo sapiens
  misc_feature: GZ8MTXP01D1IJP.11.57.F02.1.454.CMB.2.raw
  modified_base (265)..(265): a, c, t, g, unknown or other
  modified_base (294)..(294): a, c, t, g, unknown or other
  modified_base (379)..(379): a, c, t, g, unknown or other
  modified_base (541)..(541): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaaacaactacttagcctggttaccaanagaaacctggccaggctcccaggctcctnatctatgatgctagtttagggacggccagtcggcactccccacctaggtttcagtgcaggtgggtctgggacagacttcattccncaaccatcccgctacgccctaaggacgtcctagaaagttattttcgacttaagttttattacttgtacaacgagcgtagcagcgacggccgtccggcgtacgtccggacgaagggaccgaaggtaggaagtcgaaggcgaacgttggtcggctcggcaccgnttcgtgttccttctactcctttcccgcttaagttcg

SEQ ID NO: 441154 - DNA, 703 bp, Homo sapiens
  misc_feature: GZ8MTXP01B6VA7.11.57.F02.1.454.CMB.2.raw
  modified_base (283)..(283): a, c, t, g, unknown or other
  modified_base (287)..(287): a, c, t, g, unknown or other
  modified_base (440)..(440): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtacaaaatattaaacaacttactagctgtaccaacagaacctgcaggctccagcncctnatctatgatgactagtttaggacgggccacgtggaccactccccacccgtagggttccaggttcggactagggttcgggtcgtacggggacctagtaccttcatttccaccaacctactcccgacacgtacctaggacgtccctagtaagttnttttcgacttaagttttacttacgtgtaaccaaacgaggtcgtaagcaacggcggacggtcccggtccgggaccggtaaccggttccgggaaccggaaacggggaaacccggtaaaggggtacgggaaacgttaccgaaagggtaaccggtaaacgttgggtacgggaccttacgggcccttaaacccgttgttcccggtttaacggttccctttaacgtaacccgttccccgtttaccccggtccttaacgtttaacccggg

SEQ ID NO: 441155 - DNA, 518 bp, Homo sapiens
  misc_feature: GZ8MTXP01BN3SA.11.57.F02.1.454.CMB.2.raw
  modified_base (363)..(363): a, c, t, g, unknown or other
  modified_base (474)..(474): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccggggggtccctgagactctcctgtctagtctctggattcgcctcagtgactatgccatgaagtgggtccgcaggctccgaggtaggggctggaatggatttcatacattagcagtagtggtgacgaccntatactacgcagactctgtgaaggccatcatcatctacagagacaatgacaacaactcactgtatctagaaactacaactgcctgagaagtcgaggacacggctgttattnttagttggtcgcgacggccgttacccccgtaaggttcgaaccgg

SEQ ID NO: 441156 - DNA, 552 bp, Homo sapiens
  misc_feature: GZ8MTXP01ACN0O.11.57.F02.1.454.CMB.2.raw
  modified_base (203)..(203): a, c, t, g, unknown or other
  modified_base (261)..(261): a, c, t, g, unknown or other
  modified_base (283)..(283): a, c, t, g, unknown or other
  modified_base (285)..(285): a, c, t, g, unknown or other
  modified_base (377)..(377): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctgccaggctccagcncncatctatgatgcatttaggaggccactggcactccccacctaggttcagtgcaggtggtctgggacagtacttcattcctcaaccatcccgnacgccctaagacgtcctagaagtattttgcttagtttattactgtacaacagcgtagcagcgacggccgtccgggacgaccgttccggaccgaaggggacccaagggtcggaagtcgaaggcgaacgttggtcggcgtggccacattctgtcttcactccttcccgccttaatcg

SEQ ID NO: 441157 - DNA, 514 bp, Homo sapiens
  misc_feature: GZ8MTXP01BOHEM.11.57.F02.1.454.CMB.2.raw
  modified_base (203)..(203): a, c, t, g, unknown or other
  modified_base (327)..(327): a, c, t, g, unknown or other
  modified_base (364)..(364): a, c, t, g, unknown or other
  modified_base (366)..(366): a, c, t, g, unknown or other
  modified_base (375)..(375): a, c, t, g, unknown or other
  modified_base (492)..(492): a, c, t, g, unknown or other
  modified_base (512)..(512): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggaggccatggcatcccaccnggttcagtggcagtgggtctgggacagacttcattcncnccatcccgnagcctagacgcctgaagtatttgctagtttattactgtcaacagcgtagcagcgaggcctccggcgacgttcggcaagggaccaggtggaagtcaagcgaacgttgtggctggcacnttctgtctcatcttccgtcntc

SEQ ID NO: 441158 - DNA, 562 bp, Homo sapiens
  misc_feature: GZ8MTXP01BMU8C.11.57.F02.1.454.CMB.2.raw
  modified_base (261)..(261): a, c, t, g, unknown or other
  modified_base (289)..(289): a, c, t, g, unknown or other
  modified_base (368)..(368): a, c, t, g, unknown or other
  modified_base (399)..(399): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggtccaanagaaacctggccaggctcccaggctccnatctatgatgcatttaggaggccacgtggcactcccacccaggttcagtggcaggtgggctgggacagacttcattccncaaccatcccgcagccctagcgcctgaagtntttgctagtttattactgttacaagagcgtagactagcggacggtccgtccggcgacggttccggaccgaagggaccaagggtacggaagtacgaaggaacgaaacgttgggtacggcgttaggcaccgattctgtcttcacttccttcccgtccttaagtcg

SEQ ID NO: 441159 - DNA, 572 bp, Homo sapiens
  misc_feature: GZ8MTXP01AV18O.11.57.F02.1.454.CMB.2.raw
  modified_base (264)..(264): a, c, t, g, unknown or other
  modified_base (383)..(383): a, c, t, g, unknown or other
  modified_base (411)..(411): a, c, t, g, unknown or other
  modified_base (438)..(438): a, c, t, g, unknown or other
  modified_base (537)..(537): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatattaaacaactacttagcctggttccaanagaaacctggccaggctcccagcctcctcatctatgatgctagtttagggagggcccagtggcactccccacctaggttcaggtggcaggtggtctgggacagacttcattctcaaccntcccgcacgcctaggactcctagaagtnttttgcttagtttattactgtacaacngctaagcagcgacggccgtccggacgtaccggttccggacgaaacgggaccgaagggtggaagtacgaagcgaacgttggtacggttcgcgccacgttnttctcgttctcacttccttccctcttaacgttccg

SEQ ID NO: 441160 - DNA, 588 bp, Homo sapiens
  misc_feature: GZ8MTXP01ENL2K.11.57.F02.1.454.CMB.2.raw
  modified_base (259)..(259): a, c, t, g, unknown or other
  modified_base (261)..(261): a, c, t, g, unknown or other
  modified_base (265)..(265): a, c, t, g, unknown or other
  modified_base (271)..(271): a, c, t, g, unknown or other
  modified_base (277)..(277): a, c, t, g, unknown or other
  modified_base (279)..(279): a, c, t, g, unknown or other
  modified_base (367)..(367): a, c, t, g, unknown or other
  modified_base (384)..(384): a, c, t, g, unknown or other
  modified_base (546)..(546): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatataacaactactagctgtcaananaacngcagcnccagcncnatctatgatgctagtttaggacggccagtgcactccccacctagggttcaggtgcaggtcgggtctcgggacagtacttcattccacncatccgcacgcctagcnctagaattatttgacttagtttacttacgtgttacaacgtagcgtagacagccggacggtcccgtccggccgtaaccggttccggaaccgaaacggggaaccgaaagggttcggaaacgtacgaaacggaacgtaacgttcgggagccgtagaccaccgttnttccgttgtcttaacctacttcccttcccgtccttaagtccg

SEQ ID NO: 441161 - DNA, 624 bp, Homo sapiens
  misc_feature: GZ8MTXP01BQ7I3.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatataacaactacttagcctggttccaacagaaacctggccaggctcccaggctcctcatctatgatgcatttaggagggccactggcactcccaccaggttcagtggcaggtgggtctcgggacagtacttcattctccaaccatcccgacacgccttaggacgcccgtagaagtattttcggacttaggttttatttaccgtagttaccaaaccgaggtccgttaagaccacggcgtaacgggcccgttacccggggcgtaaccgggtttccggacccggtaaagggggaaccccgaagggttagggaacgtacgaaggaacgtaaacgttggtacgggctggccacccgattcgtaagtcttcgtacttccttcccgccttaagttccg

SEQ ID NO: 441162 - DNA, 608 bp, Homo sapiens
  misc_feature: GZ8MTXP01CI28P.11.57.F02.1.454.CMB.2.raw
  modified_base (267)..(267): a, c, t, g, unknown or other
  modified_base (576)..(576): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaaacaactacttagcctggttaccaanagaaacctggccaggctcccaggctcctcatctatgatgactagtttagggagggcccaacgtggaccactcccccaaccccgtagggtttccagggttggctaggttgggggttctagggggaacaggtactttcaatttccctacaacccatcccgacacgccctaagacgcctagaagtattttgactaagttttattactgttacaacagcgtaagcagcgacggtcccgtccggacgacgttccggaccgaagggaaccgaagggtggaacgtcgaagaacgaacgttggtggcgtggcaccgnttctgtcttcgctccttacccgtccttaatcg

SEQ ID NO: 441163 - DNA, 671 bp, Homo sapiens
  misc_feature: GZ8MTXP01AM2EH.11.57.F02.1.454.CMB.2.raw
  modified_base (204)..(204): a, c, t, g, unknown or other
  modified_base (641)..(641): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtaaccctcctcctcgcagggccgacgtacaaaataattaaactaactaacttaagtaccgtcgttaccgtaaaccaagaaaccgtacggccgacggacgtccccacggactccctccatacttatgatgccatttaaggtaggggccgacctgggtcgaactaccccgtacccccgacggtttccgacggttagggccgaggtgggggttcgtcggggtaccgagacgttctaacttcttaccacccaacttcccgccgagcctacgagctcgaaagtattttggcagttttatttacctagtactaacagcgtagtccagcgacgggccgtccggtaccgggacgtttcccggccgaacgggaaaccgaacggtagggtaacgtacgaaggcgtaacgtagttggggcttcggacaccacgttcttacgtcttcncttaccttccccgacctaacttcgttaacg

SEQ ID NO: 441164 - DNA, 555 bp, Homo sapiens
  misc_feature: GZ8MTXP01BZ9HG.11.57.F02.1.454.CMB.2.raw
  modified_base (369)..(369): a, c, t, g, unknown or other
  modified_base (398)..(398): a, c, t, g, unknown or other
  modified_base (530)..(530): a, c, t, g, unknown or other
  modified_base (552)..(552): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaacctggccaggctcccaggctcctcatctatgatgcatttaggagggccactggcactcccacccaggttcagtgcagtgggtctgggacagacttcattctcnccatcccgcacgcctagagccctgaagtnttttgctagtttattactgttcaacgagcgtagacagcgacggtcccgtccgggcgtaacggttccgggaccgaaagggggacccaaaggggtcgggaaagtcaaaggcgtaaacgttggtggctggcacgnttctgtctcgactcttcccgcnttc

SEQ ID NO: 441165 - DNA, 613 bp, Homo sapiens
  misc_feature: GZ8MTXP01DSK6L.11.57.F02.1.454.CMB.2.raw
  modified_base (243)..(243): a, c, t, g, unknown or other
  modified_base (265)..(265): a, c, t, g, unknown or other
  modified_base (295)..(295): a, c, t, g, unknown or other
  modified_base (368)..(368): a, c, t, g, unknown or other
  modified_base (424)..(424): a, c, t, g, unknown or other
tcagcgagagataccacgaccggtgctcgatttagctcgatatagttgggtttgggggcagggtgtacacctgtggttctcggggctgccctttggctttggagatggttttctcgagtgggggctgggagggtctttgttggagaccttgcacttgtactccttgccattcagccagtcctggtgcaggacggtgaggacgctgaccacacggtacgtgcttgttgtactgcctcctcccgnggtcttttgtcttggctattangccaccctccacgccgtccacgtaccagtnaacttgacctcgagggtcttcgtggcctcaccgtcccaccaccacgcatcgtcgacccgtcgacggggtcccnccgaggcctcccgagggtagggctaggaatggtatttcatacattagcagtagtgngcgactatatactacgacagtactcgtggtacgaacggtccgtattcgacttactacttcctaccgaagaagtaaccgaaagtcggaaccaaactaactcaacttgttaactacgttaaggtaaaactcgaaacgcgaccgtaaggaacggtaacggtacgggacggaccgtaacggttaacgtttaag

SEQ ID NO: 441166 - DNA, 578 bp, Homo sapiens
  misc_feature: GZ8MTXP01A0XM9.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctcccaggctcctcatctatgatgctatttaggagggccactggcatccccaccaggttcagtggcaggtgggtctcgggacagtcttcattctcaaccatcccgcacgtcctagagtccctgtaagtacttttgactagtttattactgtacaacagcgtagcagcgacggcctccgggacgtacgttccggacgaagggaaccaggtggaacgtcgaaggcgtaaacgttggtcgggctacggccaccgttattcgtcggttcttccgacttcccgttaccccgtccttaacgttcg

SEQ ID NO: 441167 - DNA, 608 bp, Homo sapiens
  misc_feature: GZ8MTXP01D12DK.11.57.F02.1.454.CMB.2.raw
  modified_base (262)..(262): a, c, t, g, unknown or other
  modified_base (375)..(375): a, c, t, g, unknown or other
  modified_base (381)..(381): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttccaanagaaacctggccaggctccaggctcctcatctatgatgctagtttaggagggccacgtggcactccccacccgaggtttcagtggcaggtgggtctgggacagacttcattcncaaccntcccgacagccctagacgtcctagtaagtattttggacttagttttattactgttacaacgagacgtagcagcgacggcccgtccggcgtacgttcggaccgaacgggaaccgaagggtaggaacgtcgaaaggaacgtaaacgttgggttacggcgtacggaccaaccgttacttccgttaacgttcctttccgtacttcccttaccccggtccttaacgtttccg

SEQ ID NO: 441168 - DNA, 616 bp, Homo sapiens
  misc_feature: GZ8MTXP01B4A3O.11.57.F02.1.454.CMB.2.raw
  modified_base (236)..(236): a, c, t, g, unknown or other
  modified_base (290)..(290): a, c, t, g, unknown or other
  modified_base (294)..(294): a, c, t, g, unknown or other
  modified_base (333)..(333): a, c, t, g, unknown or other
  modified_base (367)..(367): a, c, t, g, unknown or other
  modified_base (369)..(369): a, c, t, g, unknown or other
  modified_base (387)..(387): a, c, t, g, unknown or other
  modified_base (426)..(426): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacagtcaccctctcctgcagggccagtacaaaatnttaaacaactacttagcctggttaccaacagaaacctggccaggctcccaggcncctnatctatgatgcatttaggaggccacgtggcatcccaccnggttcagtgcagtggctgggacagacttcattcncncatccgcagcctaagacncctagaagtatttgactagtttattacctagtcaaacgngacgtagacacgcggacggtccgtccggaccggtaccgtaccggaccggaaacgggaaccgtaaaggggtacggaaacgtaccgaaacggaacggtaaacgttgggtacggcgtacgaacccttacgttacgttccgttaacgttccgtttccgtacgttccccgttaccccgtaaccgttaacgttccg

SEQ ID NO: 441169 - DNA, 529 bp, Homo sapiens
  misc_feature: GZ8MTXP01ATHLQ.11.57.F02.1.454.CMB.2.raw
  modified_base (262)..(262): a, c, t, g, unknown or other
  modified_base (287)..(287): a, c, t, g, unknown or other
  modified_base (368)..(368): a, c, t, g, unknown or other
  modified_base (370)..(370): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggcncctcatctatgatgcatttaggaggccactggcatccccaccaggttcagtggcaggtgggtctgggacagacttcattcncnccatcccgcagcctagagcctgaagtattttgctagtttattactgtacaacagcgtagcagcgaggcctccggcgacgttcggaccgaagggaccaggtgaagtcgaagcgaacgttggtggctgcaccgattctgtctcatccttcccgcttaatcg

SEQ ID NO: 441170 - DNA, 541 bp, Homo sapiens
  misc_feature: GZ8MTXP01EC9I4.11.57.F02.1.454.CMB.2.raw
  modified_base (204)..(204): a, c, t, g, unknown or other
  modified_base (264)..(264): a, c, t, g, unknown or other
  modified_base (289)..(289): a, c, t, g, unknown or other
  modified_base (370)..(370): a, c, t, g, unknown or other
  modified_base (514)..(514): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaaacaactacttagcctggttccaaanagaaacctggccaggctcccaggcncctcatctatgatgcatttaggagggccatggcatcccaccaggttcagtgcagtgggtctggggacagacttcattctcnccatcccgcagccctagagccctgaagtattttgctagtttattaactgttacaacagacgtagcagcgaggccgtccggcgacggttcggccgaaaggggaccgaaggtaggaaagtcaaaggcgaaacttggtggctgcacnttctgtcttcatccttccgtccaatcg

SEQ ID NO: 441171 - DNA, 570 bp, Homo sapiens
  misc_feature: GZ8MTXP01B9FNO.11.57.F02.1.454.CMB.2.raw
  modified_base (204)..(204): a, c, t, g, unknown or other
  modified_base (263)..(263): a, c, t, g, unknown or other
  modified_base (287)..(287): a, c, t, g, unknown or other
  modified_base (291)..(291): a, c, t, g, unknown or other
  modified_base (446)..(446): a, c, t, g, unknown or other
  modified_base (537)..(537): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaacaactacttagcctggttccaanagaaacctggccaggctccaggcncctnatctatgatgctagtttagggacgggccacgtggcactccccacccgtagggtttcagtggctaggtgggtctggggacagtacttcattcctcaaccatcccgcacgcctagacgcctgtaagtatttgacttaagtttattactgtacaacgngcgtagcagcgacgggcctccggacgtacgttccggaccgaaggtaccgagggtggaacgtcgaaagcgtaagttggtaggcgtgcaccgnttcgtcgtcttcacttccttcccgcttaattcg

SEQ ID NO: 441172 - DNA, 658 bp, Homo sapiens
  misc_feature: GZ8MTXP01BLMZG.11.57.F02.1.454.CMB.2.raw
  modified_base (260)..(260): a, c, t, g, unknown or other
  modified_base (285)..(285): a, c, t, g, unknown or other
  modified_base (364)..(364): a, c, t, g, unknown or other
  modified_base (366)..(366): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcaggccagtacaaatattaacaactacttagcctggtaccaanagaacctgccaggctccaggctccncatctatgatgcagtttaggagggccactggcatccccacctaggttcagtggcaggtgggtctggacagactcattcncnccatccgcacgcctagacgcctagaactatttgcttagtttattacgtgtacaacgagcgttagctacggcggaacggtcccgttacccgggaccggtaaaccgggttccgggaacccgtaaacgggggaacccggaaagggtacggggtaaacggttccgaaagggaaccggtaaaacggttcggttcggggaccgttacgggacccttaaacccttacggttacccttcggtttccgtttaaccgtaaccgttccctttccccccgggaaccgtttaaccgtttaacccg

SEQ ID NO: 441173 - DNA, 536 bp, Homo sapiens
  misc_feature: GZ8MTXP01BWQVL.11.57.F02.1.454.CMB.2.raw
  modified_base (204)..(204): a, c, t, g, unknown or other
  modified_base (368)..(368): a, c, t, g, unknown or other
  modified_base (509)..(509): a, c, t, g, unknown or other
  modified_base (533)..(533): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccactggcatcccaccaggttcagtggcagtggtctgggacagacttcattctcnccatcccgcagcctagacgcctgagtattttgctagtttattactgtacaacagcgtagacagcgacgggcctccgggcgtacggttcggaccgaaggggaccaagggtggaagtcgaagcgaacttggtcggcgtgcacnttctgtcttcactcttcccgcttntcg

SEQ ID NO: 441174 - DNA, 532 bp, Homo sapiens
  misc_feature: GZ8MTXP01BPB9D.11.57.F02.1.454.CMB.2.raw
  modified_base (204)..(204): a, c, t, g, unknown or other
  modified_base (366)..(366): a, c, t, g, unknown or other
  modified_base (504)..(504): a, c, t, g, unknown or other
  modified_base (529)..(529): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccatggcatcccaccaggttcagtggcaggtggtctgggacagacttcattcncaaccatcccgcacgcctagacgcctagaagtatttgctagtttattactgtacaacagcgtagcagcgacggcctccggcgacgttcggccgaagggaccgaaggtggaagtcgaagcgaacttggtggcgtgcacnttctgtcttcactccttcccgtccngtc

SEQ ID NO: 441175 - DNA, 640 bp, Homo sapiens
  misc_feature: GZ8MTXP01CUXT0.11.57.F02.1.454.CMB.2.raw
  modified_base (205)..(205): a, c, t, g, unknown or other
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtcaccctctcctgcagggccagtacaaaatattaacaactacttagcctggtccaacagaaacctgccaggctccagcnctcatctatgatgctatttaggagggccactggcatccccaccaggttcagtggctagtgggtctcgggacagacttcattctcaaccatcccgacacgcctagacgcctagtaacgtattttgcttaagtttaattactcgttacaacgtagaccgtagacgacggcgtaacgggtcccgtaccgggccggtaaccggttccgggacccggaacggggtaaacccgaagggttacgggaaacgtacgaacggtaacgtaaacgttcggtggacgtaccggacaaccccgttaagttccgttaacggttccttaaccttacgttccctttcccccggtaaccttaacgtttcccg

SEQ ID NO: 441176 - DNA, 595 bp, Homo sapiens
  misc_feature: GZ8MTXP01DS3VH.11.57.F02.1.454.CMB.2.raw
  modified_base (283)..(283): a, c, t, g, unknown or other
  modified_base (285)..(285): a, c, t, g, unknown or other
  modified_base (387)..(387): a, c, t, g, unknown or other
  modified_base (555)..(555): a, c, t, g, unknown or other
  modified_base (563)..(563): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatataacaactacttagcctgttaccaacagaacctgccaggctccagcncncatctatgatgctagtttagggacgggccagtcggcactccccaccaggtttcaggtgcaggtgggtctggggacagtacttcattccacaaccatcccganacggcctaagcgtcctagaagttactttgactagttttatactgtacaacgtgacgtagacgtagccggaacggtccgttacccgggacggtaaccggttccggaccgtaaaggggaacccgtaagggtggaaacgtcaaaggcgaacgttgtagggctgccaccttnttacgttntccttctacgttcccttccctcttaagttccg

SEQ ID NO: 441177 - DNA, 674 bp, Homo sapiens
  misc_feature: GZ8MTXP01DCXAN.11.57.F02.1.454.CMB.2.raw
  modified_base (204)..(204): a, c, t, g, unknown or other
  modified_base (283)..(283): a, c, t, g, unknown or other
  modified_base (625)..(625): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccacctctcctgcaggccagtacaaaatattaaacaactacttagcctggtaccaacagaaacctgcagctccagcnctcatctatgatgctagtttaggacgggtcccaagtggacctactaccccacccgtagggtttcaggtggacgtaggtgggtcgtacgggaccagtacttcattcctacaacctatcccgacacgcctaagacgtcctagaagttattttcgactagttttactacttgtacaacgagtcgtagcgtaagaccggacggtccccggttaccgggacggtaacccgggttccggaaccggtaaacggggaaacccgtaaagggggttacggaaaggtaccgaaagggaacggtaaacgttgggtacggcgttaacgggacccttaacccgttattcccggttnttacctttaaccgtaccttcccgtttaccccgcccttaacgtttcccgg

SEQ ID NO: 441178 - DNA, 565 bp, Homo sapiens
  misc_feature: GZ8MTXP01D04IL.11.57.F02.1.454.CMB.2.raw
  modified_base (204)..(204): a, c, t, g, unknown or other
  modified_base (262)..(262): a, c, t, g, unknown or other
  modified_base (282)..(282): a, c, t, g, unknown or other
  modified_base (284)..(284): a, c, t, g, unknown or other
  modified_base (304)..(304): a, c, t, g, unknown or other
  modified_base (372)..(372): a, c, t, g, unknown or other
  modified_base (527)..(527): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctgtaccaanagaacctggcagctccagcncnatctatgatgcagtttaggngggccacgtggcatccccaccgaggtttcagtggcaggtgggtctggggacagtacttcattcctacnccatcccgcagcctagacgtcctagaagtattttgacttagtttattactgtacaacagcgtagcagcggacggtccgtccggcgacgttccggaccgaaggggaaccaagggtggaacgtcgaaagcgtaacgttggtcggctggacaccgttnttcctgttacttcacttccttcccgtccgttaattccg

SEQ ID NO: 441179 - DNA, 559 bp, Homo sapiens
  misc_feature: GZ8MTXP01BAH3Q.11.57.F02.1.454.CMB.2.raw
  modified_base (290)..(290): a, c, t, g, unknown or other
  modified_base (371)..(371): a, c, t, g, unknown or other
  modified_base (373)..(373): a, c, t, g, unknown or other
  modified_base (523)..(523): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctnatctatgatgctagtttagggagggccatggcatccccaccaggtttcagtggcaggtgggtctgggacagacttcattcncnccatcccgcacgccctagacgtcctagaagtatttgctagtttattactgtacaacagcgtagcagcgacggtccctccggcgtacgttccggaccgaagggtaccaagggtggaacgtcgaagcggaacttgggtacgcgtcgccacgnttccgtgttcttcacttccgttcccgcttaagtccg

SEQ ID NO: 441180 - DNA, 623 bp, Homo sapiens
  misc_feature: GZ8MTXP01CITSM.11.57.F02.1.454.CMB.2.raw
  modified_base (262)..(262): a, c, t, g, unknown or other
  modified_base (286)..(286): a, c, t, g, unknown or other
  modified_base (393)..(393): a, c, t, g, unknown or other
  modified_base (399)..(399): a, c, t, g, unknown or other
tcagcgagagataccacgaccggtgctcgatttagctcgatatagttgggtttgggggaggaactgctcagttaggacccagagggaaccatggaagccccaggtcagcttctcttcctcctgctacactggctcccagataccaccggagaaattgtgttgacacagtctccggccaccctgtctgcgtctccgtggggaaacagtcaccctctcctgcagggccagtacaaaatattaacaactacttagcctgtccaanagaacctggccaggctccagctcncatctatgatgctagtttaggacggcctactggccactccccaccgtaggtttcaggtggctaggtggggtctggggacccaggtacttcgtattcctaaccacctntcccgntacgcctagacgtcctagtaagttatttgacttagtttattacttagtacaactaggcgtagactagccgtacggggcccgttcgggaccgtacggttccggaccgaaacgggaccgtaagggtggaacgtacgaaaggtcgaacgtggttacgggcttggacctaccgagttcttcgttcttcctaacgtttcccttaccccgttccttaacgttccgttaag

SEQ ID NO: 441181 - DNA, 564 bp, Homo sapiens
  misc_feature: GZ8MTXP01EGMH0.11.57.F02.1.454.CMB.2.raw
  modified_base (204)..(204): a, c, t, g, unknown or other
  modified_base (262)..(262): a, c, t, g, unknown or other
  modified_base (282)..(282): a, c, t, g, unknown or other
  modified_base (284)..(284): a, c, t, g, unknown or other
  modified_base (362)..(362): a, c, t, g, unknown or other
  modified_base (373)..(373): a, c, t, g, unknown or other
  modified_base (553)..(553): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaaatattaaacaactacttagcctggtccaanagaaacctgcagctccagcncnatctatgatgctagtttaggaggccagtggcactcccaccaggttcagtggcaggtggtctggacagacttcattccncaacatcccgnacgcctagacgtcctagagtatttgactagtttattactgtacaacgagacgtagcacgcgacggccgtaccgggacgtacggttcggaccgaagggaacccgaagggtggaaagtacgaaaggaacgtaaacgttggtacgcgtcggcaccgttattctgttcttcacttccgttcccnccgttaattcg

SEQ ID NO: 441182 - DNA, 550 bp, Homo sapiens
  misc_feature: GZ8MTXP01DGXGX.11.57.F02.1.454.CMB.2.raw
  modified_base (241)..(241): a, c, t, g, unknown or other
  modified_base (353)..(353): a, c, t, g, unknown or other
  modified_base (405)..(405): a, c, t, g, unknown or other
  modified_base (473)..(473): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgcctcctcccgnggtctttgtcttggcattatgcaccctccacgccgtccacgtaccagtgaacttgacctcagggtcttcgtgctcacgtccaccaccacgcatgtcgacctcgagggtcccncaggcctccgagggtaggctggatggtatttcatacattagcagtagtggtnacgacatactactacgacagactctggtagaaggtccgattccgattccattccgtacagacgacaancgacaacactcaactgttatcagaaatcaacgcgttacctaagaacgtaacggtcggaacggacgtcggttcttaag

SEQ ID NO: 441183 - DNA, 591 bp, Homo sapiens
  misc_feature: GZ8MTXP01B0NCV.11.57.F02.1.454.CMB.2.raw
  modified_base (368)..(368): a, c, t, g, unknown or other
  modified_base (428)..(428): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgcatttaggaggccatggcatccccaccaggttcagtggcaggtgggtctgggacagacttcattcncaaccatcccgcacgcctagacgccctagtaagtatttgcttagtttattactgtacaanagacgtagacagcgacggtccgtccggacgtacggttccggaccgaacggggtaccgaagggtaggaaacgtacgaaaggcgtaaacgttggtcgggctcggccaacccgttattcgttaacgttcctttctacttcccgttaccccgtccttaacgtttccg

SEQ ID NO: 441184 - DNA, 789 bp, Homo sapiens
  misc_feature: GZ8MTXP01EMFQX.11.57.F02.1.454.CMB.2.raw
  modified_base (789)..(789): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgttctccctgggggaacacgtacgtacctacccttcctccgtcgacggacggacctaacgtaaactaaaattaactaaactaacttacgtacgtcgttacgtaaccaacgaacgtaaccgtcggaccgacggtccctaccggacgtcccttcctactactacttagtagtagtcgactttaagggttaacggggccgtacctaagggtccgaactaccccgtacccccgaacggttacggttaccgtagggttccgacggttagggggttcggtttaccggggacggggtaaactacggttaccctttacttaaccgtttccctaacccgaaaccttacccgggtccctaccgaccgttaccggtaagggtacccttacgtaaggtaaacttttgttcgaacggttttaatttttacgtacgttacaaccgaagtacggttacggacacggaacgggtcgaccggggtccccggtaccgggaacggttaccggtcccgggaaaccggaaacgggtaacgaggggtaacgtacgaacggaaaggtaccttaggtgcgtcacgacccgttattctcgtattcactcgtttcccctccgttgtn

SEQ ID NO: 441185 - DNA, 536 bp, Homo sapiens
  misc_feature: GZ8MTXP01CIUL4.11.57.F02.1.454.CMB.2.raw
  modified_base (203)..(203): a, c, t, g, unknown or other
  modified_base (262)..(262): a, c, t, g, unknown or other
  modified_base (287)..(287): a, c, t, g, unknown or other
  modified_base (290)..(290): a, c, t, g, unknown or other
  modified_base (375)..(375): a, c, t, g, unknown or other
  modified_base (431)..(431): a, c, t, g, unknown or other
  modified_base (509)..(509): a, c, t, g, unknown or other
  modified_base (532)..(532): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctggttccaanagaaacctggccaggctcccaggcnctnatctatgatgcatttaggagggccagtggcatccccaccctaggtttcaggtggcaggtgggtctcggggacagacttcattccncaaccatcccgcagccctagcgcctgaagtatttgctagtttattactgtacaacngcgtagctagcgaggccgtccggcgacgttcggccgaagggaccaaggtggaagtcgaagcgaattggtggctgcacnttctgtcttcactcttaccgccngtcg

SEQ ID NO: 441186 - DNA, 650 bp, Homo sapiens
  misc_feature: GZ8MTXP01EKTZ3.11.57.F02.1.454.CMB.2.raw
  modified_base (204)..(204): a, c, t, g, unknown or other
  modified_base (288)..(288): a, c, t, g, unknown or other
  modified_base (376)..(376): a, c, t, g, unknown or other
  modified_base (590)..(590): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaacaactacttagcctggttccaacagaaacctggccaggctcccaggcnctcatctatgatgcatttaggagggccatggcatccccaccaggtttcagtggcaggtggtctcgggacagacttcattcctcaaccntcccgcacgcctagacgtccctagaagtattttgactagttttacttaactgttacaacgtagtacgtaagcgacggtccgaacgggtcccgttacccggggacgtacccgggtttccgggacccgtaaacggggaaccccgtaaagggtacgggtaaacggtaccgaaaggccggtaaacgttggtacgggcgttacgggccttaacccgttnttccgttaacggttccttccgttaaccgttccctttaccccggaacccttaagtttcccg

SEQ ID NO: 441187 - DNA, 522 bp, Homo sapiens
  misc_feature: GZ8MTXP01D7R0O.11.57.F02.1.454.CMB.2.raw
  modified_base (372)..(372): a, c, t, g, unknown or other
  modified_base (457)..(457): a, c, t, g, unknown or other
  modified_base (474)..(474): a, c, t, g, unknown or other
  modified_base (483)..(483): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaagtgtccagtgcgaggtgcaagtggtgcagtcgtgggggagcttagtccgaggcccggggggtccctgagactctcctgtctagtctctggattcgcctcagtgactatgccatgaagtgggtccgccaggcctccgagggtaaggggctggaatggtatttcatacattacgcagtagtggtgaccgaccntatactacgcagactcgtgtgaggccattcatcatctccagagacaatgacaacaactcactgtatctagaatacacagcctagngaagtcgaggacacggntgttaattnttagtgtagcgacgacgcccccttaagggcgtaaccggg

SEQ ID NO: 441188 - DNA, 568 bp, Homo sapiens
  misc_feature: GZ8MTXP01CC1HH.11.57.F02.1.454.CMB.2.raw
  modified_base (262)..(262): a, c, t, g, unknown or other
  modified_base (285)..(285): a, c, t, g, unknown or other
  modified_base (368)..(368): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggtccaanagaaacctgcaggctcccaggcnctcatctatgatgctatttaggagggccagtggcactccccaccaggttcagtggcagtggtctgggacagcttcattcctcnccatcccgcagccctagacgcctagaagtatttgctagtttattactgtacaacagcgtaagcagcgacggccctccgggcgtacggttccggaccgaaggggaccaagggtggaacgtcgaaggcgaacgttggtacggctcggcacccgttattccttggttccttctacttcccgttacccgtccgttaactttccg

SEQ ID NO: 441189 - DNA, 529 bp, Homo sapiens
  misc_feature: GZ8MTXP01BP51S.11.57.F02.1.454.CMB.2.raw
  modified_base (500)..(500): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaacctggccaggctcccaggctcctcatctatgatgcatttaggagggccatggcatccccacccaggttcagtggcagtgggtctgggacagacttcattctcaaccatcccgcagccctagagcctgaagtattttgctagtttattactgtacaacagcgtagcagcaggcctccggacgcgtcggccgaagggaccaaggtggaagtcaaggcgaacttggtgcgtgcaccgnttcgtgtcttcattccttcccgcaactcg

SEQ ID NO: 441190 - DNA, 523 bp, Homo sapiens
  misc_feature: GZ8MTXP01B1YZ2.11.57.F02.1.454.CMB.2.raw
  modified_base (282)..(282): a, c, t, g, unknown or other
  modified_base (308)..(308): a, c, t, g, unknown or other
  modified_base (456)..(456): a, c, t, g, unknown or other
  modified_base (488)..(488): a, c, t, g, unknown or other
  modified_base (515)..(515): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccgaggcccgggggggtccctgagactctcctgtctagtctctggattcgcctnagtgactatgccatgaagtgggtccnccgaggctccgagggtaaggggctagggaatggtatttcatacattagctagtagtggtgacgaccaatatactacgcagactcgtgtgacggccgatcatcatctccagagacaatgacaacactcactagtatctagaaatcaacncgcctagagaagtcgaggacaggctgttattnttagtgtgcgagccgccccgtaagggngtaaccgg

SEQ ID NO: 441191 - DNA, 658 bp, Homo sapiens
  misc_feature: GZ8MTXP01BX6FM.11.57.F02.1.454.CMB.2.raw
  modified_base (286)..(286): a, c, t, g, unknown or other
  modified_base (380)..(380): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaaacaactacttagcctggtacaacagaaacctgccagctccagcnctcatctatgatgactagtttaggaggccagtcggacactccccgacctaggtttcaggtggcaggtgggtctagggacagtacttcacttccncaaccatcccgacacggtccctaagacgtcctagtaacgtattttcgacttaagtttattactgttacaacgtagtaccgtagacgagtcggacggtcccgtaccggacggtaaccggttaccgggaccggaaacggggtaaacccggtaaaggggttacggggaaaacggttaccggaaaacgggaacgtaaaaccggttggttaacggcgttacggaccaacccgttattccgttgttaccttctacgttcccttacccggtcccttaagtttccg

SEQ ID NO: 441192 - DNA, 520 bp, Homo sapiens
  misc_feature: GZ8MTXP01DCF23.11.57.F02.1.454.CMB.2.raw
  modified_base (306)..(306): a, c, t, g, unknown or other
  modified_base (359)..(359): a, c, t, g, unknown or other
  modified_base (367)..(367): a, c, t, g, unknown or other
  modified_base (383)..(383): a, c, t, g, unknown or other
  modified_base (484)..(484): a, c, t, g, unknown or other
tcagcgagagataccacgaccggtgctcgatttagctcgatatagttgggtttggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggcccggggggtccctgagactctcctgtctagtctctggattcgcctcagtgactatgccatgaagtgggtccncaggctccgaggtaagggctggaatggatttcatacattacgctagtagtggngaccgacntatactacgcagctcngtgaaggcgattcatcatctcagagacaatgacaacgaactcgactgtatcgtagaaatacaacgagcctaggagaacgtcgaggacacggtctgttattnttattgtgcgagaccgccccgtaacggcgtaaccgg

SEQ ID NO: 441193 - DNA, 588 bp, Homo sapiens
  misc_feature: GZ8MTXP01BAN9B.11.57.F02.1.454.CMB.2.raw
  modified_base (204)..(204): a, c, t, g, unknown or other
  modified_base (289)..(289): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttccaacagaaacctggccaggctcccaggcncctcatctatgatgcagtttaggagggccatggcactccccaccaggttcaggtggcaggtgggtctcgggacagtacttcattctcaaccatcccgcacgcctagacgcctagaagtatttgacttagtttattacgtgtacaacgagtacgtagactagcgacggcccgtccgggcgtaccggttccggaccgaacggggaaccgaagggtaggaacgtacgaaggcgtaaacgttggtacggcgtcgccgaccttacttcgttgtcttcacgttcccttcccgtccttaagttccg

SEQ ID NO: 441194 - DNA, 545 bp, Homo sapiens
  misc_feature: GZ8MTXP01A2ZA0.11.57.F02.1.454.CMB.2.raw
  modified_base (204)..(204): a, c, t, g, unknown or other
  modified_base (262)..(262): a, c, t, g, unknown or other
  modified_base (370)..(370): a, c, t, g, unknown or other
  modified_base (386)..(386): a, c, t, g, unknown or other
  modified_base (519)..(519): a, c, t, g, unknown or other
  modified_base (524)..(524): a, c, t, g, unknown or other
  modified_base (545)..(545): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctcctcatctatgatgcagtttaggagggccactggcactccccaccagttcagtggcagtggtctgggacagtactcattctcnccatccgcagcctagngcctagaagtattttgactagtttattaactgttacaacgtagcgtaagcagcgacggtccgtccggcgtacgttccggccgaagggaccgaaggtggaagtcgaagcgaaacttgtaggcgtggcaccgttnttctntctctcttcttcctcttcgtn

SEQ ID NO: 441195 - DNA, 647 bp, Homo sapiens
  misc_feature: GZ8MTXP01DHE3B.11.57.F02.1.454.CMB.2.raw
  modified_base (264)..(264): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaaacaactacttagctgtaccaanagaacctggccaggctccagctcctcatctatgatgctagtttaggacgggccagtcggacactccccaccgtaggtttccaggtggcgtaggtggggtctacggggacagtacttcattcctcaaccatcccgacacgtccgtaagacgtcctagtaagtattttgacttagtttaattactgtacaaacgtagtacgtagcgtaacgcggacggtcccgttaccgggacggtaccggttccgggaccggaaacggggtaaacccgtaaagggtacgggtaaacggtaacgaacggtaacggtaaacgttgggttcggcgtacggacttacccttagttccttggttaccttcacgttcccttacccgtccgttcttaaccg

SEQ ID NO: 441196 - DNA, 531 bp, Homo sapiens
  misc_feature: GZ8MTXP01ATEW5.11.57.F02.1.454.CMB.2.raw
  modified_base (204)..(204): a, c, t, g, unknown or other
  modified_base (262)..(262): a, c, t, g, unknown or other
  modified_base (368)..(368): a, c, t, g, unknown or other
  modified_base (370)..(370): a, c, t, g, unknown or other
  modified_base (379)..(379): a, c, t, g, unknown or other
  modified_base (387)..(387): a, c, t, g, unknown or other
  modified_base (499)..(499): a, c, t, g, unknown or other
  modified_base (503)..(503): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctcctcatcatgatgctatttaggagggccactggcatccccaccaggttcagtgcagtgggtctggggacagacttcattcncnccatcccgnagcctagnccctagaagtattttgctagtttattactgtcaatagcgtagcagcgaggtcctccggcgacgttcggaccaagggaccaaggtgaacgtcgaagcgaacttggtgcgtgcnccgnttctgtcttcactccttccgccaattcg

SEQ ID NO: 441197 - DNA, 700 bp, Homo sapiens
  misc_feature: GZ8MTXP01CFJPY.11.57.F02.1.454.CMB.2.raw
  modified_base (204)..(204): a, c, t, g, unknown or other
  modified_base (214)..(214): a, c, t, g, unknown or other
  modified_base (261)..(261): a, c, t, g, unknown or other
  modified_base (267)..(267): a, c, t, g, unknown or other
  modified_base (280)..(280): a, c, t, g, unknown or other
  modified_base (283)..(283): a, c, t, g, unknown or other
  modified_base (289)..(289): a, c, t, g, unknown or other
  modified_base (371)..(371): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccacggagaaattgtgttgacacagtctccggccaccctgtctgcgtctccgtaggggaaacngtccaccctntcctgcaggccagtacaaaatattaaacaactactagctggtacaanagaacngcaggctccagcnctnatctangatgactagtttaggacggcacgtggcactccccaccgtaggttcaggtggcaggtgggtctacgggacagtactcatttcnccaaccacgtccgactacgacctaggacgtccctagaacgtttagttgacttaagtttattacgttagtaacaacgacgtacgtagacgagacgggaacggtcccggttaccgggaccggtaaccgggtttcccgggaaacccggaaacgggggtaaacccggtaaagggggtaacgggttaaaccgggtaaacggaaacgggtaacggtaaaaccgggttgggttaaccgggcgttaaccggaccgttaacccttacgtttccgggttccttacccgtttaaccgtaacccttccccgttaccccgtaaccgttaactttaacccggg

SEQ ID NO: 441198 - DNA, 512 bp, Homo sapiens
  misc_feature: GZ8MTXP01DJ9HE.11.57.F02.1.454.CMB.2.raw
  modified_base (202)..(202): a, c, t, g, unknown or other
  modified_base (259)..(259): a, c, t, g, unknown or other
  modified_base (366)..(366): a, c, t, g, unknown or other
  modified_base (415)..(415): a, c, t, g, unknown or other
  modified_base (471)..(471): a, c, t, g, unknown or other
  modified_base (476)..(476): a, c, t, g, unknown or other
  modified_base (488)..(488): a, c, t, g, unknown or other
  modified_base (509)..(509): a, c, t, g, unknown or other
tcagcgagagataccacgaccggtgctcgatttagctcgatatagttgggtttggggaggaactgctcagttaggacccagagggaaccatggaagcccagctcagcttctcttcctcctgctactctggctcccagataccaccggagaaattgtgttgacacagtctccggccaccctgtctgcgtctcctggggaaacngtcacctctcctgcagggccagtcaaaatattaacaactacttagcctggttccaanagaaacctggccaggctcccaggctcctcatctatgatgcatttaggaggccatggcatccccaccaggtttcagtggcagtgggtctgggacagacttcattctcnccatcccgcagcctagagcctgagatttgctagtttattactgtcaacngcgtagcagcgacggcctccggcgacgtcggccaagggaccaaggtgaagtcaagngaacngtggctgcacgnttctgtcttcatcttccgtcntcg

SEQ ID NO: 441199 - DNA, 667 bp, Homo sapiens
  misc_feature: GZ8MTXP01DHCUK.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaaatattaaacaactacttagcctggttaccaacagaaacctggccaggctccaggctcctcatctatgatgctagtttagggagggccacgtggcactccccacccgtagggtttcaggtggcaggtgggtctcggggacagtcttcattcctacaaccatcccggacacgccctaggacgtccctagtaagtattttgacttaagttttacttacgttgtactaaacgagtacgtagacgacggtcgaacgggtcccgttaccgggcgtaccggttaccgggacccgaaacgggggtaacccgaaaggggtacgggaaagtaccgaaagggaacggtaaaccgttggggtcggacgttacggcccgttaaccgttacgttccgttcggttacctttcctacgttccccgtttccccggcccgttaacgtttcccg

SEQ ID NO: 441200 - DNA, 604 bp, Homo sapiens
  misc_feature: GZ8MTXP01B1SAL.11.57.F02.1.454.CMB.2.raw
  modified_base (355)..(355): a, c, t, g, unknown or other
  modified_base (417)..(417): a, c, t, g, unknown or other
tcagcgagagataccacgaccggtgctcgatttagctcgatatagttgggtttggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgcggtctttgtcttggctattatgcacctccacgccgtccacgtaccagtgaacttgacctcgagggtctcgtgctcacgtcccaccaccacgcatgtcgaccctcgacgggggtccnccaggcctccccgaggggtaggggctggaatgggatttcgatacattagctagtagtgggtnacgaccatactactacgcagtactcgtggtacgaacgggtccgtattcgaattcaacttccgtaaccgaagtaacgaactaaagtcggaaccaaactactcaacgttgttaactacgttaggaaaacttccaaacgcgttaccgtaaggaggtaacggtacggacggacgtaaccgggttctttaag

SEQ ID NO: 441201 - DNA, 791 bp, Homo sapiens
  misc_feature: GZ8MTXP01A1LSE.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaaacaactacttagcctggttccaacagaaacctggccaggctcccaggctcctcatctatgatgctatttagggaggccagtggaccaactcccccaacccgtagggtttccagggttcggacctagggttcggggttactcgggggaacctaggtacctttccaacgttttacccaccaacccgtaacgttcccccgggactacggtccccgttaagggaccgtacccgttaggttaaaggttacgtttttttacggaccgtttaaacggtttttaactttaaccgttacggtttaacccaaacgtacggtaccggttaacgacccgtaacggccggtaacggggtccccgttacccggggaccggttaacccggggttacccgggaccccggtaaacgggggtaaccccggtaaacggggtacggggtaaaccggttaccgaaaggggaacccggtaaacgttcgggttccgggaccgttcgggaacccttaccgttacgttccgttaacggttcctttccacgttcccgttaccccgtcttaacgttccg

SEQ ID NO: 441202 - DNA, 595 bp, Homo sapiens
  misc_feature: GZ8MTXP01B90YH.11.57.F02.1.454.CMB.2.raw
  modified_base (265)..(265): a, c, t, g, unknown or other
  modified_base (383)..(383): a, c, t, g, unknown or other
  modified_base (419)..(419): a, c, t, g, unknown or other
  modified_base (546)..(546): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaaacaactacttagcctggttaccaanagaaacctggccaggctcccaggctcctcatctatgatgactagtttaggagggccagtggccactccccacctaggtttcaggtggctaggtgggtctcgggactagacttcattcncaaccatcccgacacgcctagacgtcctagaagttntttgacttagttttattactgtacaacgtagcgtagcagcggacggccctaccggcgtacgtcggaccgaagggaccgaagggtgaagtcgaaggcgtaacgttgggtacgcgtacgccttaaccgngttccgttgttcctttcgtacttcccgttacccgtaaccttgttaaccg

SEQ ID NO: 441203 - DNA, 523 bp, Homo sapiens
  misc_feature: GZ8MTXP01C0P69.11.57.F02.1.454.CMB.2.raw
  modified_base (305)..(305): a, c, t, g, unknown or other
  modified_base (386)..(386): a, c, t, g, unknown or other
  modified_base (410)..(410): a, c, t, g, unknown or other
  modified_base (424)..(424): a, c, t, g, unknown or other
  modified_base (434)..(434): a, c, t, g, unknown or other
  modified_base (477)..(477): a, c, t, g, unknown or other
  modified_base (490)..(490): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgctattttagaaggtgtccagtgcgaggtgcaagtggtgcagtcgtgggggagtcttagtccgaggcccggggggtcctgagactctcctgtctagtctctggattcgctcagtgactatgccatgaagtgggtccnccaggctcgagggtaagggctaggatggatttcatacattacgctagtagtggtgacgaaccaatatactacgcagactcngtagaggccatcatcatcacaganacatgaccaatacnctactgtaancgtaagaatacaacagctagacgaagtcgaagggtacacggtntagttattagttnttgcgtcgagacccgccccgtaaggcgtaaccg

SEQ ID NO: 441204 - DNA, 520 bp, Homo sapiens
  misc_feature: GZ8MTXP01ADUMJ.11.57.F02.1.454.CMB.2.raw
  modified_base (364)..(364): a, c, t, g, unknown or other
  modified_base (373)..(373): a, c, t, g, unknown or other
  modified_base (485)..(485): a, c, t, g, unknown or other
  modified_base (495)..(495): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccatggcatcccaccaggttcagtgcagtggtctgggacagacttcattctcnccatcccgnacgcctagacgcctgaagtatttgctagtttatactgtacaacagcgtagcagcgaggcctccggcgacgttcggccgaagggaccaaggtcggaagtcgaagcgaacttgnggctgcacgnttctgtcttcatcttcccgcaatcg

SEQ ID NO: 441205 - DNA, 525 bp, Homo sapiens
  misc_feature: GZ8MTXP01C9WPG.11.57.F02.1.454.CMB.2.raw
  modified_base (262)..(262): a, c, t, g, unknown or other
  modified_base (367)..(367): a, c, t, g, unknown or other
  modified_base (502)..(502): a, c, t, g, unknown or other
  modified_base (512)..(512): a, c, t, g, unknown or other
  modified_base (522)..(522): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcatttaggaggccatggcatcccaccaggtttcagtggcagtggtctgggacagcttcattcctcnccatcccgcagccctagacgcctgaagtatttgctagtttatactgtacaacagcgtagcagcgaggccctccggcgtacgttccggaccgaagggaccaagggtagaagtcaaggcgaacttgtggctgcacgnttctgtctcnctcttccgcntcg

SEQ ID NO: 441206 - DNA, 545 bp, Homo sapiens
  misc_feature: GZ8MTXP01EQLGC.11.57.F02.1.454.CMB.2.raw
  modified_base (203)..(203): a, c, t, g, unknown or other
  modified_base (258)..(258): a, c, t, g, unknown or other
  modified_base (278)..(278): a, c, t, g, unknown or other
  modified_base (281)..(281): a, c, t, g, unknown or other
  modified_base (390)..(390): a, c, t, g, unknown or other
  modified_base (515)..(515): a, c, t, g, unknown or other
  modified_base (542)..(542): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactactagctgtccaanagaaacctgcagctccagcnctnatctatgatgcagtttaggaggccacgtggcactccccaccaggttcaggtggcaggtggtctaggggacagtacttcattcctcaaccatcccgcaggccctaggacncctagagtattttgctagtttattactgtacaagagcgtagcgacgcgacggccgtccggcgtacgttcgacgaacgggaccgaagggtgaagtacgaagaacgaacgttggtagcgtgccacgnttctgtcttcacttccgttcctcgttntcg

SEQ ID NO: 441207 - DNA, 596 bp, Homo sapiens
  misc_feature: GZ8MTXP01B1B1Z.11.57.F02.1.454.CMB.2.raw
  modified_base (263)..(263): a, c, t, g, unknown or other
  modified_base (284)..(284): a, c, t, g, unknown or other
  modified_base (286)..(286): a, c, t, g, unknown or other
  modified_base (374)..(374): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaanagaaacctgcaggctccagcncncatctatgatgcagtttaggagggccagtggacactccccacccgaggttcagtggcaggtgggtctgggacagtacttcatttcacnccatcccgcacgcctagacgcctagaatatttgactagtttattactgtacaagagcgtagctagcgaacggtcccgttccggaccgtaaccggttccggaaccgaaagggaacccgaagggttagggaaacgtaccgaaaggtaacgtaaacgttggtacgggttctcgtacgacccgttattccgtgtccttctacgtcctttaccccgcttaagttccg

SEQ ID NO: 441208 - DNA, 586 bp, Homo sapiens
  misc_feature: GZ8MTXP01C0HVF.11.57.F02.1.454.CMB.2.raw
  modified_base (204)..(204): a, c, t, g, unknown or other
  modified_base (257)..(257): a, c, t, g, unknown or other
  modified_base (275)..(275): a, c, t, g, unknown or other
  modified_base (278)..(278): a, c, t, g, unknown or other
  modified_base (299)..(299): a, c, t, g, unknown or other
  modified_base (401)..(401): a, c, t, g, unknown or other
  modified_base (543)..(543): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcaggccagtacaaaatataacaactatagctgtccaanagaactgcagctccagcnctnatctatgatgctagtttaggngggccagtcggcactcccaccgtaggtttcaggtgcaggtgggtctcggggacagtcttcattacctcaaccatcccgacacgcctagacgcctagaagttntttgacttagtttatactgtacaacagcgtagacacgcggtacggcccgtccgggacgtacgttcggaccgtaaacggggaccgtaaagggtggaaacgtacgaaggaacgtaacgttgggtacgcgtacggcttaaaccgnttaccgtgttccttctaccttccgttccccgtcttaacttccg

SEQ ID NO: 441209 - DNA, 560 bp, Homo sapiens
  misc_feature: GZ8MTXP01BVRV9.11.57.F02.1.454.CMB.2.raw
  modified_base (278)..(278): a, c, t, g, unknown or other
  modified_base (364)..(364): a, c, t, g, unknown or other
  modified_base (388)..(388): a, c, t, g, unknown or other
  modified_base (426)..(426): a, c, t, g, unknown or other
  modified_base (525)..(525): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagctgtcaacagaacctgcaggctccagcnctcatctatgatgcagtttaggagggccactggcaactccccaccaggtttcagtgcaggtgggtctgggacagtacttcattccncaaccatcccgcacgcctaggacnccctagaagtatttgcttagtttattactgtacaacgngcgtagcgagcggacggcccgtccggacgtacggtccggaccgaacgggaaccgaagggtaggaacgtcgaagccgaagttggtacgcgtcggcaccgnttcgtgtcttcacttcgttcccgcttaacgttccg

SEQ ID NO: 441210 - DNA, 587 bp, Homo sapiens
  misc_feature: GZ8MTXP01EVOAQ.11.57.F02.1.454.CMB.2.raw
  modified_base (215)..(215): a, c, t, g, unknown or other
  modified_base (392)..(392): a, c, t, g, unknown or other
  modified_base (422)..(422): a, c, t, g, unknown or other
  modified_base (431)..(431): a, c, t, g, unknown or other
  modified_base (534)..(534): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaacagtcaccctctccngcaggccagtacaaatattaacaactacttagcctggttccaacagaaacctggccaggctcccaggctcctcatctatgatgctatttaggagggccactggcactccccaccaggttcagtggcagtgggtctgggacagacttcattctcaaccatcccgcacgccttaggacncctagaagtattttgactagtttattacgngtacaacgngtcgtagcgagcggcggtcccgtccggacggtaccggttccggaccggaacgggtacgaagggtacggaacgacgaaggaacgtaacgttggtcggcgtacgnaccgttaccttacgtccgtcgttccttctacttcccttccccgttccgtaacg

SEQ ID NO: 441211 - DNA, 630 bp, Homo sapiens
  misc_feature: GZ8MTXP01DS2SG.11.57.F02.1.454.CMB.2.raw
  modified_base (204)..(204): a, c, t, g, unknown or other
  modified_base (261)..(261): a, c, t, g, unknown or other
  modified_base (284)..(284): a, c, t, g, unknown or other
  modified_base (370)..(370): a, c, t, g, unknown or other
  modified_base (392)..(392): a, c, t, g, unknown or other
  modified_base (401)..(401): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcagggccagtacaaaatattaacaactacttagctggtccaanagaacctgcaggctccagctccnatctatgatgctatttaggacgggccacgtggcactccccaccgtaggttcaggtgcaggtgggtctcgggacagacttcattccncaaccatcccgcacgcctagcncctagaatntttgctagtttatactgtacaacgagcgtagcacgcgaacgggtcccgtaccgggacggtaccggttccgggaccgaaaggggaaacccgtaaagggtacgggaaacgttaccgaaagggtaaccggtaaacgttgggtacgggccgtacggacccaaccggttattcccgttggtttacccgtttaacctaccggttcccctttaccccggtccgttaactttcccgg

SEQ ID NO: 441212 - DNA, 601 bp, Homo sapiens
  misc_feature: GZ8MTXP01CLTI3.11.57.F02.1.454.CMB.2.raw
  modified_base (204)..(204): a, c, t, g, unknown or other
  modified_base (394)..(394): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaacaactacttagcctggttccaacagaaacctggccaggctcccaggctcctcatctatgatgctatttaggagggccactggcactccccaccgtaggttcagtggcaggtgggtctgggacagacttcattctcaacatccgcagcctagacnctagagtatttgctagtttattactgtacaacagacgtagacagcgacggtccgtccggacgtacgttccggaccgtaagggacccgaagggtggaagtacgaaggtccggtaaacgttgggtacggcgttacggccttaaccgttacgttccgttcgttcctttaacctacgtttcccctttaccccggtcccttaacgtttcccg

SEQ ID NO: 441213 - DNA, 563 bp, Homo sapiens
  misc_feature: GZ8MTXP01AO8J0.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaaacaactacttagcctgttaccaacagaaacctggccaggctcccaggctcctcatctatgatgcatttaggagggccatggcactcccaccaggttcagtggcagtgggtctcgggactagacttcattcctcaaccatcccgcagcctagacgcctgagtatttgactagtttattactgttcaacagcgtagcagcgacggccgtccggacgtaccggttcggccgaaggggacccaagggtcggaagtcgaaggcgaagttggtggcgtcggacacccgttattccgtgtcttccacttcccttcccgtccaacttaaccg

SEQ ID NO: 441214 - DNA, 676 bp, Homo sapiens
  misc_feature: GZ8MTXP01DELDR.11.57.F02.1.454.CMB.2.raw
  modified_base (205)..(205): a, c, t, g, unknown or other
  modified_base (267)..(267): a, c, t, g, unknown or other
  modified_base (289)..(289): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactacttagcctggttaccaanagaaacctgccaggctccagcncctcatctatgatgactagtttaggacgggccacgtggcactccccacctaggttcaggtgcaggtggtctcgggacagtactcattctcaaccatcccgactacgaccctaggacgtcccgtagtaaagttattttacggacttaagtttttaacttacgttacgttacaaaccgtagtacgtaagactagcggacgggtcccgttacccggacggtaaccggttccggacccgaaacggggtaaacccgtaaaggggttacggaaacggtacgaaacgggtaaccgtaaacgttcgggttacggccttacggacccttaacccgttattaccgtttcttacctttaacctacgttaccccgtttccccgaaccgttaacgttccg

SEQ ID NO: 441215 - DNA, 528 bp, Homo sapiens
  misc_feature: GZ8MTXP01BO3KI.11.57.F02.1.454.CMB.2.raw
  modified_base (204)..(204): a, c, t, g, unknown or other
  modified_base (262)..(262): a, c, t, g, unknown or other
  modified_base (370)..(370): a, c, t, g, unknown or other
  modified_base (428)..(428): a, c, t, g, unknown or other
  modified_base (487)..(487): a, c, t, g, unknown or other
  modified_base (500)..(500): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaanagaaaccctggccaggctcccaggctcctcatctatgatgcatttaggagggccatggcatccccaccaggttcagtggcaggtgggtctgggacagacttcattccncaaccatcccgcacgcctagagcctgaacgtattttgctagtttattactgtacaacngcgtagcagcgaggcctcggcgtacgtcgcgaagggaccaggtgaagtcgaagcgaacnggtggctgcaccnttctgtctcactccttcccgcttaagtc

SEQ ID NO: 441216 - DNA, 572 bp, Homo sapiens
  misc_feature: GZ8MTXP01EV2LJ.11.57.F02.1.454.CMB.2.raw
  modified_base (263)..(263): a, c, t, g, unknown or other
  modified_base (285)..(285): a, c, t, g, unknown or other
  modified_base (288)..(288): a, c, t, g, unknown or other
  modified_base (375)..(375): a, c, t, g, unknown or other
  modified_base (407)..(407): a, c, t, g, unknown or other
  modified_base (534)..(534): a, c, t, g, unknown or other
  modified_base (561)..(561): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaacaactacttagcctggttccaanagaaacctgccaggctccagcnccnatctatgatgctagtttaggacgggccagtggcactccccaccgtaggtttcagtggcaggtgggtctgggacagacttcactttcncaaccatcccgcacgcctagcgcctagaagtnttttgactagtttacttactgtacaacgagcgtagcacgcgacggtccgtccggacgtacggtcgaccgaagggaccgtaagggtgaaagtcgaagcgtaaacgttgggtacgcgtacgccttacgnttcgtgtaccttctactcccgttcccncttaacgttcg

SEQ ID NO: 441217 - DNA, 631 bp, Homo sapiens
  misc_feature: GZ8MTXP01BT5OQ.11.57.F02.1.454.CMB.2.raw
  modified_base (310)..(310): a, c, t, g, unknown or other
  modified_base (367)..(367): a, c, t, g, unknown or other
  modified_base (369)..(369): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggnggccagtggcatccccaccaggttcagtgcaggtggtctgggacagacttcattccncnccatcccgcacgcctaagacgccctagaacgtatttgacttagtttattactgtactaacgagcgtagctagcgacgggccgtccgggccggtacggttccggaccgtaaagggggaacccgtaaaggggtacggggaaacgtccgaaacgggtaaccggtaaacgttcggggttacgggacgttacgggacccaaccgttacttccgttaacggttccttaaccgtacttccccgttaccccggtaacccgttaacttccg

SEQ ID NO: 441218 - DNA, 648 bp, Homo sapiens
  misc_feature: GZ8MTXP01CTY72.11.57.F02.1.454.CMB.2.raw
  modified_base (261)..(261): a, c, t, g, unknown or other
  modified_base (357)..(357): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttcgtactgcctccgtccgcgtctttgtcttggctattngccacctccacgccgtccacgtaccagtcacttcgacctcgtagggtctcgtgctcaccgtccaccaccacgcatcgtcaccgtcggacgggtccncgaggcctacccggaggggtacgggctaggtaatggtatttcgaatactagttacgcgtaggttggtggcgacgaacctaatactaccgaccgatacgtactcgtaggtacggaacggggtacctaattcgaactctactcctacgaagtacgaactaaacgtcgaaacctaaactaacctctaacttgttacgttaaccgttaaggtaaaacttccgaaaacgttcggttaaccgtaagggaaacggttcggtaacccgggaggttaaccgtaaccggggttctttaagg

SEQ ID NO: 441219 - DNA, 761 bp, Homo sapiens
  misc_feature: GZ8MTXP01AGJS6.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcaggccagtacaaaatattaaacaactacttagctaggttccaacagaacctggccaggctccgaggctcctcgtctatgatgctagtttaggacgggccacgtggcactccccaccaggttccaggtggctaggtgggtcgtggggactaggactttcactttcctaacaccctaacgtcccgacacgtcccgtagacgccgttaaggtaaagttacgtttttacggacgttaacggtttttaatttaaccgtttacggtacctaaaacgtacgggtaccgttaacggacgtaaacgggccgaaccggggggtccccggttaccccgggggaccggttaaaccccggggtttacccggggaacccggtaaacgggggaaaccccgtaaagggggttacgggaaacggttaccgaaacgggtccggaaaaccggttgggttacggggcccttacggaacccgtacccgttaacgttccgttacggttccttacgtaacccttttccccgtaccccggttccgtaaccgttcccgtttaaggg

SEQ ID NO: 441220 - DNA, 654 bp, Homo sapiens
  misc_feature: GZ8MTXP01EX7UW.11.57.F02.1.454.CMB.2.raw
  modified_base (285)..(285): a, c, t, g, unknown or other
  modified_base (288)..(288): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtggggaaacagtccaccctctcctgcagggccagtacaaaatattaacaactacttagcctggtccaacagaacctgcaggctccagcnctnatctatgatgctagtttagggacgggccacgtcggcctactcccccgaccgtaggtttcgaggtggcgtaggtcgggtcgtacgggacagtacttctacttccaccaaccactcccgacacgtcctaggacgtaccgtagtaaagttagttttcgacgttaagttttattaaccgtgttaacaaacgtaggacgtacgacacggaccggcgggtacccgtccgggacgtaccggttaccggaccggaaacgggaccgaagggtacggaacgtacgaaacggaaccgtaacgttggcggctcggcccaaccttcgttccgttaacgtcctttaacccacgttccccttcccgaaccttaacgttccg

SEQ ID NO: 441221 - DNA, 600 bp, Homo sapiens
  misc_feature: GZ8MTXP01BF06R.11.57.F02.1.454.CMB.2.raw
  modified_base (204)..(204): a, c, t, g, unknown or other
  modified_base (258)..(258): a, c, t, g, unknown or other
  modified_base (278)..(278): a, c, t, g, unknown or other
  modified_base (281)..(281): a, c, t, g, unknown or other
  modified_base (357)..(357): a, c, t, g, unknown or other
  modified_base (359)..(359): a, c, t, g, unknown or other
  modified_base (367)..(367): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtcaaaatattaacaactactagcctgtccaanagaacctgcaggctccagcnctnatctatgatgctagtttaggaggccagtggcactccccaccagttcagtgcaggtggtctgggacagactcattcncncatcccgnacgcctagactcctagaacgttattttgctaagttttatacgtgttacaacgagcgtagactagcgaacggtcccgtccgggcgtacggttcccggaccgaaaggggacctaaggggtggaacgtcgaaaggcggtaaacgttgggtacggccttacggacccttaacccgttgtttcgtcgtttacctttcctaaccgttcccgtttaccccggaaccgttaacgtttccgg

SEQ ID NO: 441222 - DNA, 524 bp, Homo sapiens
  misc_feature: GZ8MTXP01CHGLM.11.57.F02.1.454.CMB.2.raw
  modified_base (311)..(311): a, c, t, g, unknown or other
  modified_base (374)..(374): a, c, t, g, unknown or other
  modified_base (379)..(379): a, c, t, g, unknown or other
  modified_base (388)..(388): a, c, t, g, unknown or other
  modified_base (405)..(405): a, c, t, g, unknown or other
  modified_base (410)..(410): a, c, t, g, unknown or other
  modified_base (483)..(483): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcttagtccgaggcccgggggggtccctgagactctcctgtctagtctctggattcgccttcagtgactatgccatgaagtgggtcccnccaggctccgagggtaggggctaggaatggtatttcatacattacgcagtagtggtgacgacnatacncgcagactngtgaggcatcatcatcncaganacaatgacaacactcactgtatctagaaatcaaacacgcctagagaagtcggaggacgacggtactgttattnttagttgtgcgacgaccgacccccgtaaggttcgaacccgg

SEQ ID NO: 441223 - DNA, 537 bp, Homo sapiens
  misc_feature: GZ8MTXP01AE8WN.11.57.F02.1.454.CMB.2.raw
  modified_base (204)..(204): a, c, t, g, unknown or other
  modified_base (263)..(263): a, c, t, g, unknown or other
  modified_base (373)..(373): a, c, t, g, unknown or other
  modified_base (385)..(385): a, c, t, g, unknown or other
  modified_base (404)..(404): a, c, t, g, unknown or other
  modified_base (430)..(430): a, c, t, g, unknown or other
  modified_base (506)..(506): a, c, t, g, unknown or other
  modified_base (518)..(518): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaaacaactacttagcctggttccaanagaaacctggccaggctcccaggctcctcatctatgatgctagtttaggagggccacgtggcatccccaccgaggttcagtggcagtgggtctgggacagacttcattcncaaccatcccgnagcctagacgcctagaatntttgcttagtttattactgtacaacngtctagcagcgagccgtcggcgtacgtcgacgaaggaccgaggtgagtcgagcgtaacgttggtcgcgtgcaccgnttcgtgtcttcnctccttcccgcttaattcg

SEQ ID NO: 441224 - DNA, 749 bp, Homo sapiens
  misc_feature: GZ8MTXP01B33IR.11.57.F02.1.454.CMB.2.raw
  modified_base (204)..(204): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcagggccagtacaaaatattaaacaactacttagcctggtccaacagaaacctggccaggctcccaggctcctcatctatgatgactagtttaggacgggccacgtggccactcccccacccgtagggtttcaggtcggacgtaggtggggtctcggggactaggtactttcgtactttccctacaaccctactccccgacaacgtcccttaaggacgtaccccgtagtaaacgttagtttttagaccgtttaagttttaactttaaccgttacgttaccgaaacgtacggtacgtacgacgtaacggaccgggtaacgggtccccggttaccccgggaccgggtaacccgggtttacccgggaaccccggaaacgggggtaaacccggtaaacgggggtaacgggtaaacggttaaccgaaacgggtaaccggtaaacggttcgggtacgggccgtacggtaccacccgttacttccgttaacggttccctttccgtaccttcccttaccccgtaaccttccgtttaacg

SEQ ID NO: 441225 - DNA, 589 bp, Homo sapiens
  misc_feature: GZ8MTXP01A8QW2.11.57.F02.1.454.CMB.2.raw
  modified_base (260)..(260): a, c, t, g, unknown or other
  modified_base (382)..(382): a, c, t, g, unknown or other
  modified_base (551)..(551): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatataacaactacttagcctggtccaanagaaacctgccaggctccaggctctcatctatgatgactagtttagggacgggccagtcggcactccccacccgtagggtttcaggtggcaggtgggtctgggacagtacttcattcctacnccatcccgcacgtcctagacgtcctagaatatttgacttagtttattacgtgtactaacagacgtagacagcgaacggcccgtccggacgtacgttccggaccgaagggaaccgtaagggtcggaagtacgaaggaacgtaaacgttggtacggcgtacgacaccgttnttccgtgtttcctctactccgttcccgtcgttaattcg

SEQ ID NO: 441226 - DNA, 566 bp, Homo sapiens
  misc_feature: GZ8MTXP01C5CKE.11.57.F02.1.454.CMB.2.raw
  modified_base (303)..(303): a, c, t, g, unknown or other
  modified_base (354)..(354): a, c, t, g, unknown or other
  modified_base (356)..(356): a, c, t, g, unknown or other
  modified_base (520)..(520): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgcctcctcccgcggtctttgtcttggctattatgccaccctccacgccgtccacgtaccagtgaacttgacctnagggtctcgtgctcacgtccaccaccacgcatgtcgacctcgaggggtccncnggctccgaggtagggctggatggatttcatacattagctaggtagtgtgcgaaccatactactacgactagactcgtagtgaacgggtccgtatttcgaacttcaacttcctacgagacgacaatcgacaacactcaactgttatacgttagaaactcaaacgngaccgtaagaggtaacgtccggaagggacctaacgggttgtttaag

SEQ ID NO: 441227 - DNA, 685 bp, Homo sapiens
  misc_feature: GZ8MTXP01ARR28.11.57.F02.1.454.CMB.2.raw
  modified_base (204)..(204): a, c, t, g, unknown or other
  modified_base (261)..(261): a, c, t, g, unknown or other
  modified_base (281)..(281): a, c, t, g, unknown or other
  modified_base (284)..(284): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctgtccaanagaacctgcaggctccagcnctnatctatgatgctatttaggaggccacgtggcactccccaccgaggttcaggtggcaggtgggtctggggacagacttcattcctcaaccatcccgacacggtcctaaggacgtccctagtaaacgttagttttgaccttaaggttttaacttacgtaggttacaaacgtacggtacgttaacgacgaacggccggtaacgggtcccgttacccggggaccggttaaccgggttccgggaaccggtaaacgggggaacccgtaaaggggtacgggaaacgttaccgaaacgggtaaccgtaaacgttcgggtacgggccgttacggaccgttacccggttattcccgttggtttccctttaacttaacgttccccgtttaccccggccttaacggtttcccg

SEQ ID NO: 441228 - DNA, 584 bp, Homo sapiens
  misc_feature: GZ8MTXP01DWFHV.11.57.F02.1.454.CMB.2.raw
  modified_base (267)..(267): a, c, t, g, unknown or other
  modified_base (538)..(538): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtacaaaatattaaacaactacttagcctaggttccaaanagaaacctggccaggctcccaggctcctcatcatgatgctagtttaggagggccagtggcactccccacctaggttcagtggcaggtgggtctgggacagtcttcattcctcaaccgatcccgacacgcctaggacgtcctagaagttatttgacttaagtttattactgtacaacgagcgtagcagcgacggccgtccggacgtacgtcgacgaagggaccgaaggtaggaagtcgaagtcgaacgttggtacggctacggcacccgttnttccgttcgttccttctacttcccgttcccgtccttaagttaaccg

SEQ ID NO: 441229 - DNA, 599 bp, Homo sapiens
  misc_feature: GZ8MTXP01D57OS.11.57.F02.1.454.CMB.2.raw
  modified_base (204)..(204): a, c, t, g, unknown or other
  modified_base (380)..(380): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtcaaaatattaacaactacttagcctggttccaacagaaacctggcaggctccagctctcatctatgatgctagtttaggagggcccagtcggaccactccccacccgaggtttcaggtggcaggtgggtctgggacagtacttcattcctacncctatcccgcacgtcctagacgtcctagtaagttattttgcttagtttacttacgttcgtacaacgagcgtagcacgcgacggtccgtccggcgtacggttacggaccgaacgggaaccgaaggtcgggaagtccgaaggaaccgtaaacgttggtcggcgtcggccaccgttacttcgttcgttcttcctacttcccgttacccgtccgttaacttcg

SEQ ID NO: 441230 - DNA, 623 bp, Homo sapiens
  misc_feature: GZ8MTXP01DZ6FE.11.57.F02.1.454.CMB.2.raw
  modified_base (266)..(266): a, c, t, g, unknown or other
  modified_base (291)..(291): a, c, t, g, unknown or other
  modified_base (421)..(421): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaaacaactacttagcctggtaccaanagaaacctggcaggctccagctccncatctatgatgactagttagggcggccacgtggccactccccaccgtaggtttcaggtggctaggtgggtcgtaggggacagtacttcattcctcaaccatcccgcacgcctagacgtcctagaacgttntttagacttaagttttacttacgtacgtacaacgagtaccgtagacgtacgcgggacggtcccgttcccgggacgtaccggttaccggaccgaaacggggaaccgtaagggtacggaaacgtcgaaaggtaacgtaacgttggtcgcgtacgaccaccttagttccttgtcttctacttcccttccgtaacccgttaattcg

SEQ ID NO: 441231 - DNA, 615 bp, Homo sapiens
  misc_feature: GZ8MTXP01B3JEK.11.57.F02.1.454.CMB.2.raw
  modified_base (204)..(204): a, c, t, g, unknown or other
  modified_base (293)..(293): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttaccaacagaaacctgccaggctcccaggctcctnatctatgatgctaagtttaggagggcccacgtggaccactcccccaccgtaggtttcaggttggccgaggtcggggtctacggggactaggtacttcgaatttccctacaacccgtatcccgacacgtcctaggacgcctagaagttatttgcttaagtttattacgtgtacaacagcgtagcacgcgacggtcccgtaccggacgtaccggttcggaccgaacgggaaccagggtgaaacgtcgaaggcgtaacgttggtacgcgtcggaccacgttagttctaagttccttaactacttccttaccccgcttaacgttcg

SEQ ID NO: 441232 - DNA, 813 bp, Homo sapiens
  misc_feature: GZ8MTXP01B2QTU.11.57.F02.1.454.CMB.2.raw
  modified_base (289)..(289): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctccagataccaccggagaaattgtgttgacacagtctccggccaccctgtctgcgtctccgtggggaaacagtccaccctctcctgcagggccagtacaaaatattaaacaactacttagcctggtaccaacagaacctggccaggctccagctccncatctatgatgactagtttagggacgggcccagtcggacctaactcccccgaaaccccgtagggtttccgaaggttcggaccgtaaggggttcgggggttaccgttacggggggaacctaacggtacccttttccgaacttttcccacccaacccgtacgttccccgaccgtaaccgtaccccgttaagggaccgtacccgttaaggttaaagtttacgtttttacgtacgtttaaacggttttttaacttaacgttacggtttaaccaaacgtaacgtacggttaacggacgtaacggaccggtaacggggtccccggttacccggggaccgggtaaccggtttcccggggaacccggtaaacgggggaaacccggtaaagggggttacggaaacggtaccggaaacgggtaaccggtaaacgttcgggtacggaccgttacggaaccttacccgttacgttaccgttcggtttacccgtttctaacctttccccgtttaccccggtaaccttaacgtttccg

SEQ ID NO: 441233 - DNA, 530 bp, Homo sapiens
  misc_feature: GZ8MTXP01DHZJP.11.57.F02.1.454.CMB.2.raw
  modified_base (372)..(372): a, c, t, g, unknown or other
  modified_base (425)..(425): a, c, t, g, unknown or other
  modified_base (502)..(502): a, c, t, g, unknown or other
  modified_base (512)..(512): a, c, t, g, unknown or other
  modified_base (523)..(523): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcacctctcctgcaggccagtcaaaatattaacaactacttagcctggttaccaacagaaacctgccaggctccgaggctctcatctatgatgctagtttaggaggccacgtggcactccccaccgaggtttcagtgcaggtggtctcgggacagacttcattctcncgatccgcagcctagacgtctagaagtatttgctagtttattactgtacaacngcgtagcagcgacgccgtcggcgacgtcgccgaagggaccaaggtggaatcgaagcgaacgttgtcggctgcaccgnttctgtctcnctccgttcccncttctcg

SEQ ID NO: 441234 - DNA, 636 bp, Homo sapiens
  misc_feature: GZ8MTXP01BEE6O.11.57.F02.1.454.CMB.2.raw
  modified_base (262)..(262): a, c, t, g, unknown or other
  modified_base (283)..(283): a, c, t, g, unknown or other
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctgtaccaanagaaacctgcaggctccagcncnatcatgatgactagtttaggacgggccagtggacctactccccacctagggtttcaggtggcaggtggtctggggacagacttcatttccacaacctactcccgactacgccctaaggactccctagaagtattttggcttaagtttattacgtgtacaacgtagacgtacgactagacggacggtcccgtccggaccggtacgttccgggaaccgtaacggggaaacccgtaaggggtaacggtaaacggtaccgaaaggtaaccggtaaacttgggtacggactacggaccttaaccgttcgttacgttcgttaccttctacttcccgttaccccgaacttaacttccg

SEQ ID NO: 441235 - DNA, 548 bp, Homo sapiens
  misc_feature: GZ8MTXP01B3BD2.11.57.F02.1.454.CMB.2.raw
  modified_base (204)..(204): a, c, t, g, unknown or other
  modified_base (264)..(264): a, c, t, g, unknown or other
  modified_base (291)..(291): a, c, t, g, unknown or other
  modified_base (369)..(369): a, c, t, g, unknown or other
  modified_base (371)..(371): a, c, t, g, unknown or other
  modified_base (379)..(379): a, c, t, g, unknown or other
  modified_base (390)..(390): a, c, t, g, unknown or other
  modified_base (426)..(426): a, c, t, g, unknown or other
  modified_base (516)..(516): a, c, t, g, unknown or other
  modified_base (522)..(522): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaaacaactacttagcctggttccaanagaaacctggccaggctccaggctccncatctatgatgcatttaggaggccatggcatccccaccaggttcagtggcaggtgggtctgggacagtacttcattcncncatcccgnacgcctagacncctgaagtatttgcttagtttatacttgtacaaagngacgtagacagcgacggcctccgggcgaccggttcgacgaagggaccaggtggaacgtcgaaagcggaacgttggtaggctcggcaccgnttcgtntccttcatccttcccgtcttaacgtc

SEQ ID NO: 441236 - DNA, 639 bp, Homo sapiens
  misc_feature: GZ8MTXP01CRWD5.11.57.F02.1.454.CMB.2.raw
  modified_base (260)..(260): a, c, t, g, unknown or other
  modified_base (267)..(267): a, c, t, g, unknown or other
  modified_base (279)..(279): a, c, t, g, unknown or other
  modified_base (281)..(281): a, c, t, g, unknown or other
  modified_base (399)..(399): a, c, t, g, unknown or other
  modified_base (440)..(440): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtacaaaatataacaactactagcctgtccaanagaaccngcagctccagcncnatctatgatgactagtttaggacggccagtcggcactccccaccgtaggttcaggtgcaggtgggtcgtcgggacagtacttcattcctaccaacctagtcccgacacgcctaagacncctagtaagttatttgacttagtttaatactgtacaaacgngacgtagcgacgtcggacggtcccgtccgggaccggtaccggttaccggaccggaaaggggacccgtaaaggggtacggaaacgtaccgaaaggtaaccggtaaacgttgggtacggacgttacggccttaaccgttagttcccttcggttccctttaaccgtaacctttccccttacccccctaagtttcccgttaag

SEQ ID NO: 441237 - DNA, 653 bp, Homo sapiens
  misc_feature: GZ8MTXP01DCKUM.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaaacaactacttagcctggtccaacagaaacctggccaggctcccagctcctcatctatgatgctatttagggaggccacgtggcactccccacctaggttcagtggcaggtgggtctggggacagtacttcattcctaccaaccactcccgacacgccctaggacgtcctagaagtattttgacttaagttttattacttagtacaaacgagtacgtagacgtagccggtaacggcccgtaccgggaccggtaccggttccgggaccgaaacggggaaacccgaaagggtacgggaaacgtcgaaaggaaccggtaaacgttcggtcggaccgtcggacccacccttagttccgtttcgttacccttttaaccgtaacctttccccgttaccccgtaacccttaacgtttcccg

SEQ ID NO: 441238 - DNA, 737 bp, Homo sapiens
  misc_feature: GZ8MTXP01CA1UM.11.57.F02.1.454.CMB.2.raw
  modified_base (261)..(261): a, c, t, g, unknown or other
  modified_base (279)..(279): a, c, t, g, unknown or other
  modified_base (282)..(282): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtacaaaatataacaactacttagcctgtacaanagaactgcagctccagcnctnatctatgatgctagtttagggaggcccagtggaccactccccaaccccgtaggtttcaggtcggacgtaggttggggtcgttcgggggaacagtacctttcaacttcctccaaccactcccggactacgcccgtagacgccctaggtaagttagttttacggacttaggttttaacttacgttacggtacctaaacgtacggtacgttaacggacgaacggcccgggtaacggggtccccgttaccccgggggacccgggttaaccgggtttcccggggaacccggaaacgggggtaaccccggtaaagggggttaaccggggaaacgttaccggaaacgggtaaccggtaaacggttcggggttacggccgttacgggcccttaaccgttacgttccgttaacggtttccttccgtaacctttcccgttccccggtaaccccttgtttaacccg

SEQ ID NO: 441239 - DNA, 612 bp, Homo sapiens
  misc_feature: GZ8MTXP01EDYMP.11.57.F02.1.454.CMB.2.raw
  modified_base (205)..(205): a, c, t, g, unknown or other
  modified_base (262)..(262): a, c, t, g, unknown or other
  modified_base (282)..(282): a, c, t, g, unknown or other
  modified_base (350)..(350): a, c, t, g, unknown or other
  modified_base (436)..(436): a, c, t, g, unknown or other
  modified_base (602)..(602): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatataacaactactagcctgtaccaanagaacctgcaggctccagcnctcatctatgatgctagttaggacggccagtggacactccccacgtaggttcaggtgcaggtgggtcncgggacagtacttcattccacaacctatcccgcacgcctaggacgtcctagaagttgtttgacttagtttacttactgtacaacgnggacgtagcacggcggacggtcccgttaccgggaccggtaaccggttccggaaccggaaacggggtaaccgtaaaggggtacggtaaacggacgaaacgggaacgtaacgttcgggtggccgtagacccacgttgttccttaagttccttctactcccgtttcccncttaacgtcg

SEQ ID NO: 441240 - DNA, 701 bp, Homo sapiens
  misc_feature: GZ8MTXP01EK5X9.11.57.F02.1.454.CMB.2.raw
  modified_base (206)..(206): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccaccctctcctgcgacgggccaagtacaaaattattaaacaacttacttacgccttaggttacccaaacaacgaaacctcggaccacggcctcccgaggtctcctcatctatgatgactagtttagggacggcctagtcggactacctaccccgaccgtacgggtttcagggttcggacgtaggggtcggggtaccgtacggggaactaggttacttctacttacctaccaacccactcccgactacgaccgtaagacgtaccgtagtaagttacttttaggactttaagtttacttacgttagttaaccaaacgtgacgtaagacgacgacggacggtcccgtccgggaccggtacgttccggaaccgaaagggaaccgtaagggtacgggtaaacgtacgaaacggaaccggtaagttcgggtcggacgtcggtaacaccgttacgttccttcgttacttctaccttccttccccgtaacgttaacttcg

SEQ ID NO: 441241 - DNA, 589 bp, Homo sapiens
  misc_feature: GZ8MTXP01BJWH3.11.57.F02.1.454.CMB.2.raw
  modified_base (473)..(473): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggttttccttgttgctattttagaggtgtccagtgcgaggtgcaagtggtgcagtcgtgggggagcttaggtccgaggcccggggggtcctgagactctcctgtctagtctctggattcgccttcagtgactatgccatggaagtcgggtcccgccaggcctccggaagggtaacgggggctagggaatggtatttcatacattagctagtagtggtcgacgaccaatactactacgcagacttcgtagtgaaggccgtatcatcatctaccgagacgacaagtcgacaacgaactcactgtatcgtaggaatacaacngtacctgaggaacggtacggagggaccgacggtacttaggttaagttagtttagttggttacggaaccggtaacggtacccggttaccccccgttaaggggttccggtaacccggg

SEQ ID NO: 441242 - DNA, 567 bp, Homo sapiens
  misc_feature: GZ8MTXP01CRM92.11.57.F02.1.454.CMB.2.raw
  modified_base (304)..(304): a, c, t, g, unknown or other
  modified_base (386)..(386): a, c, t, g, unknown or other
  modified_base (396)..(396): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaggtgtccagtgcgaggtgcaagtggtgcagtcgtgggggagcttagtccgaggccggggggtccctgagactctcctgtctagtctctggattcgcctcagtgactatgccagtgagtgggtccncaggctcgagggtaggggctagggaatggtatttcatactagttacgactagtaggtggtgacgaaccaagtactactacgnagtacttcgngtgaagggccgattcatcatctcagagacaatcgacaacgactcactagtatccgtaggaaactaccaaactacgacctagagaaggtaccggagggacgaccgggtatggttattagttagttggtacgtcgaggtacccggccccccgttaagggttccgtaacccggg

SEQ ID NO: 441243 - DNA, 546 bp, Homo sapiens
  misc_feature: GZ8MTXP01DTO5Y.11.57.F02.1.454.CMB.2.raw
  modified_base (204)..(204): a, c, t, g, unknown or other
  modified_base (260)..(260): a, c, t, g, unknown or other
  modified_base (369)..(369): a, c, t, g, unknown or other
  modified_base (512)..(512): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatataacaactacttagcctgtccaanagaaacctggcaggctccagctctcatctatgatgactagtttaggaggccactggcatccccaccgtagtttcagtgcaggtgggtctgggacagacttcattctacnccatccgcacgcctagcgacctagaagtatttgactagttttattactgtacaacagtcgtagcacgcgacggccgtcggcgtacgttcggacgaaggaccaaggtggaagtcgaaggcgaacgttggtacggcgtcgacacngttctgttccttcacttccgttcccgcttaatcg

SEQ ID NO: 441244 - DNA, 620 bp, Homo sapiens
  misc_feature: GZ8MTXP01BS637.11.57.F02.1.454.CMB.2.raw
  modified_base (365)..(365): a, c, t, g, unknown or other
  modified_base (425)..(425): a, c, t, g, unknown or other
  modified_base (614)..(614): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggcgtttgttggagaccttgcacttgtactccttgccattcagccagtcctggtgcaggacggtgaggacgctgaccacacggtacgtgctgttgtactgcctcctcccgcggtcttttgtcttggctattatgccaccctccacgcccgtccacgtaccagtcgaacttgacctgagggtcttcggtgcctcacgtcccaccaccacgcatgtcgacctcgacgggggtcccncgaggcctcccgagggtaggggctaggaatggatttcgatacattagctaggtagtggtnacgaactatatacctacgacagtactcgtaggtacgaaacgggtcctatttcgaattcctaactaccgtaccaaggaacgaaacctaaagtcggaacctaaacctaaccgttcaaacgttggttaactacgttaaggaaaactcaaacgcgccgtaaggagtaacgtaccggagggacctaacgggttntttaag

SEQ ID NO: 441245 - DNA, 574 bp, Homo sapiens
  misc_feature: GZ8MTXP01DVKGD.11.57.F02.1.454.CMB.2.raw
  modified_base (204)..(204): a, c, t, g, unknown or other
  modified_base (264)..(264): a, c, t, g, unknown or other
  modified_base (292)..(292): a, c, t, g, unknown or other
  modified_base (376)..(376): a, c, t, g, unknown or other
  modified_base (435)..(435): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttccaanagaaacctggccaggctccaggctcctnatctatgatgctagtttaggagggccacgtggcactccccaccaggtttcaggtgcaggtggtctggggacagacttcattccncaaccatcccgcacgcctagacgcctagaagtattttgctagtttattactgtacaacngacgtagctagcgacggtcctccggcgacgtcggacgtaagggaccagggtggaagtcgaaggaacgaacgttggtacggctcggccaccgttattccgttcgttcctttcacttccctttacccgccttaacgttccg

SEQ ID NO: 441246 - DNA, 526 bp, Homo sapiens
  misc_feature: GZ8MTXP01BJKFN.11.57.F02.1.454.CMB.2.raw
  modified_base (235)..(235): a, c, t, g, unknown or other
  modified_base (262)..(262): a, c, t, g, unknown or other
  modified_base (286)..(286): a, c, t, g, unknown or other
  modified_base (364)..(364): a, c, t, g, unknown or other
  modified_base (500)..(500): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatnttaacaactacttagcctggttccaanagaaacctggccaggctccaggcncctcatctatgatgcatttaggaggccatggcatcccaccaggttcagtgcagtggtctgggacagactcattcctcnccatcccgcagccctagacgccctgaagtatttgctagtttattactgtacaacagcgtagcagcgaggccgtccggcgacgttcggccgaagggaccgaaggtggaagtcgaagcgaacttgtacggctgcacgnttctgtctcactcttcccgtcaatcg

SEQ ID NO: 441247 - DNA, 757 bp, Homo sapiens
  misc_feature: GZ8MTXP01BFF7Q.11.57.F02.1.454.CMB.2.raw
  modified_base (205)..(205): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtccaccctctcctgcagggccagtacaaaatattaacaactacttagcctggttccaacagaaacctggccaggctccaggctcctcatctatgatgctagtttagggacgggccacgtggaccactccccgaccgtaggtttcaggttggctaggtgggtctggggacaggtactttcgactttacctaccaaccctagtccccggactaaccgtaccccgttaagggtaacgtccccgttaggtaaaccgttagttttttacggaccgtttaaggtttttaactttaacgttacggttaccaaacgtaggtccgttaacgacgtaacggccggggtaacgggtccccggttacccgggtaccggtaacccgggtttacccgggaccggtaaacgggggaaccccgtaaagggggttacggaaacgttacggaaacgggtaaccggtaaacgttcgggtacgggccgttacgaaccgaccgttacgttccgttaacggtttccttaaccggtaacctttcccgttaccccggtaaccttaacggtttccg

SEQ ID NO: 441248 - DNA, 722 bp, Homo sapiens
  misc_feature: GZ8MTXP01CU4AD.11.57.F02.1.454.CMB.2.raw
  modified_base (204)..(204): a, c, t, g, unknown or other
  modified_base (261)..(261): a, c, t, g, unknown or other
  modified_base (280)..(280): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaaatattaacaactacttagcctgttccaanagaacctgcagctccagcnctcatctatgatgcatttaggaggccatgcatcccaccagttcagtgcagtggtctcgggacagacttcattcctcaaccctaatcccgacgacgacccttaaggacgacccttaggtaaacgtatttttacggaccttaaaggtttttaacttaaaccgtttcggtttaacctaaaacccgtaagggaccgttaaggtaccgaaacggtccggggaaacgggtcccccggtttacccggggaacccggttaaacccggtttcccggggaaaccccggaaaacgggggtaaaccccgaaaggggtttaccggggaaaacggttcccgaaaagggaaccccggtaaacgttgggttaacggcccgtttagggacttaaaccccgttattaccgtcggtttacccttcgtaacgttccctttaccccggaaccttctttaaccg

SEQ ID NO: 441249 - DNA, 520 bp, Homo sapiens
  misc_feature: GZ8MTXP01A9W1R.11.57.F02.1.454.CMB.2.raw
  modified_base (203)..(203): a, c, t, g, unknown or other
  modified_base (286)..(286): a, c, t, g, unknown or other
  modified_base (366)..(366): a, c, t, g, unknown or other
  modified_base (368)..(368): a, c, t, g, unknown or other
  modified_base (385)..(385): a, c, t, g, unknown or other
  modified_base (493)..(493): a, c, t, g, unknown or other
  modified_base (517)..(517): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggcncctcatctatgatgcatttaggagggccactggcatcccaccaggttcagtggcagtgggtctgggacagacttcattcncnccatccgcagcctagancctgaagtatttgctagtttattactgtcaacagcgtagcagcgaggcctccggcgacgttcggccgaagggaccaaggtggaagtcgaagcgaacttgtgctgcacnttctgtcttcactcttcccgcttntcg

SEQ ID NO: 441250 - DNA, 592 bp, Homo sapiens
  misc_feature: GZ8MTXP01CN5UM.11.57.F02.1.454.CMB.2.raw
  modified_base (204)..(204): a, c, t, g, unknown or other
  modified_base (282)..(282): a, c, t, g, unknown or other
  modified_base (291)..(291): a, c, t, g, unknown or other
  modified_base (556)..(556): a, c, t, g, unknown or other
  modified_base (567)..(567): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtacaaaatattaacaactactagcctggtccaacagaaacctgccaggctccagcnctcatctangatgcatttaggaggccacgtggccaatccccacctagttcagtggcgagtgggtctcggggacagtacttcagttctcaacccatcccgacacgtccctaaggacgaccctagaaagtattttcgactagtttattacttagttacaacgagcgtacgacgtagacgtacggcccgtccgacggtacgttccggaccgaagggaacccgtaaggtacggtaaagtccgaaaggccgtaaagttcgggtacgcgtaggcaaccgnttctgtccttnacttccgttacctccgttaacttcg

SEQ ID NO: 441251 - DNA, 624 bp, Homo sapiens
  misc_feature: GZ8MTXP01ENKPT.11.57.F02.1.454.CMB.2.raw
  modified_base (259)..(259): a, c, t, g, unknown or other
  modified_base (376)..(376): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatataacaactacttagctgtccaanagaacctgcaggctccagctctcatctatgatgctagtttaggagggccatcggcactccccaccgaggtttcaggtggactaggtcgggtcgtcgggacagtacttcacttctacnccatcccgcacgcctaggacgtcctagaacgtatttgcttagtttattaacgtgttacaacgtagcgtagacgacgacggtacggggcccgtccgggtaccgtaccgggttaccggaccggtaaacggggaccgtaaagggggttacgggaaacgtaccgaacgggaacgtaaacgttggtcgggacgtcggtaccaccttattccgttaacgttcttctacttccgttaccccgtccttaagttccg

SEQ ID NO: 441252 - DNA, 534 bp, Homo sapiens
  misc_feature: GZ8MTXP01ETSQZ.11.57.F02.1.454.CMB.2.raw
  modified_base (204)..(204): a, c, t, g, unknown or other
  modified_base (234)..(234): a, c, t, g, unknown or other
  modified_base (260)..(260): a, c, t, g, unknown or other
  modified_base (283)..(283): a, c, t, g, unknown or other
  modified_base (285)..(285): a, c, t, g, unknown or other
  modified_base (400)..(400): a, c, t, g, unknown or other
  modified_base (505)..(505): a, c, t, g, unknown or other
  modified_base (517)..(517): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtcaaaatnttaacaactacttagcctggtccaanagaaacctggcaggctcccagcncnatctatgatgcatttaggagggccacgtggcactcccaccagggttcagtggcagtgggtctggggacagactttcattcctcaaccatcccgcagccctaagcgtcctgaagtnttttgctagtttattactgtacaactgcgtagcagcgaggcctcggcgtacgtcgacgaagggtaccagggtagaagtcgaagcgaacgttggtagcgtgcaccngttctgtcttcntccttccgtcttaatcg

SEQ ID NO: 441253 - DNA, 524 bp, Homo sapiens
  misc_feature: GZ8MTXP01ATXSK.11.57.F02.1.454.CMB.2.raw
  modified_base (497)..(497): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccactgacatccccaccaggttcagtggcagtggtctgggacagacttcattctcaaccatcccgcagcctagacgcctgaagtattttgctagtttatactgtcaacagcgtagcagcgaggccgtccggcgacgttcggccaagggaccaaggtgaagtcaagcgaacttgtcggctgcacgnttctgtcttcatccttccgtccaatcg

SEQ ID NO: 441254 - DNA, 600 bp, Homo sapiens
  misc_feature: GZ8MTXP01ASSQT.11.57.F02.1.454.CMB.2.raw
  modified_base (285)..(285): a, c, t, g, unknown or other
  modified_base (289)..(289): a, c, t, g, unknown or other
  modified_base (387)..(387): a, c, t, g, unknown or other
  modified_base (402)..(402): a, c, t, g, unknown or other
  modified_base (552)..(552): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaacagaacctggcaggctccagcncctnatctatgatgcagtttagggacgggcccagtcggcactaccccacccgtaggtttcaggttggctaggtggggtctggggacagtaccttcatttccnccaacctatcccggnacgccctagggactccgtagtaaagtattttgcttaagttttacttactcgttacaacgagacgtagcacgcggacggtcccgtccgggacgtaaccggttcggaaccgaagggtaccgaagggtacggaagtccgaagcgaacgttggnggactgaccacgttcttctgttcttctactcccttcccgcttaactcg

SEQ ID NO: 441255 - DNA, 547 bp, Homo sapiens
  misc_feature: GZ8MTXP01B8L58.11.57.F02.1.454.CMB.2.raw
  modified_base (310)..(310): a, c, t, g, unknown or other
  modified_base (471)..(471): a, c, t, g, unknown or other
  modified_base (478)..(478): a, c, t, g, unknown or other
  modified_base (498)..(498): a, c, t, g, unknown or other
  modified_base (508)..(508): a, c, t, g, unknown or other
  modified_base (516)..(516): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaaggtggtgcaggtcgtggggggagcttaggtccgaggcccggggggtcctgagctctcctgtctagtctctggattcgctcagtgactatgccatgaagtgggtcccnccgaggctccgaagggtaaggggctagggaatggtatttcaatacattacgcgaggtacgtggtcgaacgaaccaattatactacgcagactctagtgaacggccattcatcaatccacagagacaatgacaaacactcactagtatcgtagaaatccaangcctagngaaggtccgaggacacggtntagttagttnttagttgngcgtacgccgaccccgtaaggcgtaaccggg

SEQ ID NO: 441256 - DNA, 787 bp, Homo sapiens
  misc_feature: GZ8MTXP01ELPKF.11.57.F02.1.454.CMB.2.raw
  modified_base (262)..(262): a, c, t, g, unknown or other
  modified_base (283)..(283): a, c, t, g, unknown or other
  modified_base (287)..(287): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacagtcaccctctcctgcagggccagtacaaaatattaacaactacttagcctgttaccaanagaaacctggcagctccagcncctnatctatgatgactagtttaggacggccacgtggccactccccaccgtaggtttcaggtcggactaggtggtccgtaggggacctaggtacctttacactttccctaccgtaacccgtacgttcccgactaacggtccccgttaagggacgtacccgttaaggtaaacgttagtttttacggaccgtttaaggtttttaaacttttaaccgttacggttaacctaaaccgtaacggtaccggttaacgtaccgtaacggaccgggtaaccggggtccccggttaccccggggacccggtaacccgggtttccggggaacccgtaaacgggggtaaaccccggtaaaacggggttacggggaaaaccggttccggtaaaagggaacccggtaacggttacggggtacggaccgttacgggaacccttaaccgttcgttaccgttcggtttaccctttcgtaacccgtttccccgttccccggtaaccttaacgtttaacccg

SEQ ID NO: 441257 - DNA, 597 bp, Homo sapiens
  misc_feature: GZ8MTXP01CFSRD.11.57.F02.1.454.CMB.2.raw
  modified_base (204)..(204): a, c, t, g, unknown or other
  modified_base (383)..(383): a, c, t, g, unknown or other
  modified_base (394)..(394): a, c, t, g, unknown or other
  modified_base (405)..(405): a, c, t, g, unknown or other
  modified_base (415)..(415): a, c, t, g, unknown or other
  modified_base (554)..(554): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctggttccaacagaaacctggccaggctcccaggctcctcatctatgatgctagtttaggacgggccacgtggccactccccacccgtaggtttcaggtggcaggtgggtctcgggacagacttcattccncaacatcccgnacgcctagacncctagaagtntttgcttagtttattactgtacaacagcgtaagctaggcgacggtcccgtccgggcgtaccggttccggaccgaaaggggaccgaagggtcggaacgtcgaaaggcgtaaacgttggtacggccgtacggccaccgttnttccttgttccttcgtacttcccgttcccgccttaagtttccg

SEQ ID NO: 441258 - DNA, 634 bp, Homo sapiens
  misc_feature: GZ8MTXP01AJ21P.11.57.F02.1.454.CMB.2.raw
  modified_base (286)..(286): a, c, t, g, unknown or other
  modified_base (397)..(397): a, c, t, g, unknown or other
  modified_base (581)..(581): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcaggccagtacaaaatattaacaactacttagcctggttccaacagaaacctggccaggctccaggcncctcatctatgatgctagtttaggacgggtccacgtggccactccccacccgtagggtttccaggttcggcgtaggttcggggtcgtcggggactaggtaccttcattccnccaacccatcccgcacgcctaggacgtccctagaacgtattttgacttaagtttattactgtacaacgagtcgtagcaggcgacggcccgtccggaccgtaccggttccggaccgaacgggaccgaagggtcggaaacgtacgaaggaacgaacgttgggtcggcgtacggaccttaaccgttnttccgttaacgttccttcctaacgttcccgttccccgtaacttaacgtttccg

SEQ ID NO: 441259 - DNA, 649 bp, Homo sapiens
  misc_feature: GZ8MTXP01C0569.11.57.F02.1.454.CMB.2.raw
  modified_base (206)..(206): a, c, t, g, unknown or other
  modified_base (298)..(298): a, c, t, g, unknown or other
  modified_base (401)..(401): a, c, t, g, unknown or other
  modified_base (468)..(468): a, c, t, g, unknown or other
  modified_base (573)..(573): a, c, t, g, unknown or other
  modified_base (599)..(599): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctccagataccacggagaaattgtgttgacacagtcctccggccaccctgtctgcgtctccgtaggggaaacngtccaccctctcctgcagggccaagtacaaaatattaaacaactacttagcctggtaccaacaagaaacctggccaggctcccgagctcctnatctatgatgtctagtttagggcggccacgtgcactccccaccgtaggttcaggtggacgtaggtgggtcgtacgggactacgtacttcaattcccacaaccnctccgacacgtacctagacgtcctagtaagttattttgacttagtttacttacgtcgtactaaacgngacgtgacgacggcgggtaccggcccgttccgggacggtacggtacccgggaaccgtaaacggggaaccggaagggtaacgggtaagaccgaaagggcgtaacgngggttacgcgttacgaccttacgttnttaccgttcgttaccttcgtacctttccgttacccgtcccttaagttccg

SEQ ID NO: 441260 - DNA, 570 bp, Homo sapiens
  misc_feature: GZ8MTXP01B4EGV.11.57.F02.1.454.CMB.2.raw
  modified_base (238)..(238): a, c, t, g, unknown or other
  modified_base (354)..(354): a, c, t, g, unknown or other
  modified_base (437)..(437): a, c, t, g, unknown or other
tcagcgagagataccacgaccggtgctcgatttagctcgatatagttgggtttggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgngtctttgtcttggctattatcgcacctccacgccgtccacgtaccagtcgaacttgacctcgagggtctcgtgctcaccgtccaccaccacgcatcgtgaccctcgacggggtccncgaggctacccgagggtaaggggctggaatggatttcatacattagctaggtagtggtgcgacatatactagacagctcgtgngaacggcgattcatcatcaccaagacgaacatcggaccaaacaactcaacgtgttagtccttaggtaaaactccgaaacgcgacccgttaagaacggaacggtccgggaaggaccgaaccggttcgtttaagg

SEQ ID NO: 441261 - DNA, 649 bp, Homo sapiens
  misc_feature: GZ8MTXP01B4QS2.11.57.F02.1.454.CMB.2.raw
  modified_base (200)..(200): a, c, t, g, unknown or other
  modified_base (252)..(252): a, c, t, g, unknown or other
  modified_base (264)..(264): a, c, t, g, unknown or other
  modified_base (270)..(270): a, c, t, g, unknown or other
  modified_base (273)..(273): a, c, t, g, unknown or other
  modified_base (386)..(386): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctccagataccacggagaaattgtgttgacacagtctccggccacctgtctgcgtctcgtagggaaacngtcacctctcctgcaggccagtacaaaatataaacaactatagctgtacaanagaactgcagcnccagcnctnatctatgatgctagtttaggacggccagtggaccactccccgaccgtagggtttcaaggtggactaggtcggggtctaggggacagtaccttcatttccacaaccatcccganaacgtccgtaaggactcctagaagttatttagacttaagtttattaacgtgtaaccaaacgaggcgtaagcaaggcggaacgggtcccgtccgggaccggtaccggttccgggaaccgaaacggggtaaccgtaaaggggtacggaaaggttaccgaaagggaacccgtaaacgttggttacgggcccgttaacgaacccgttaaccgttcgttaccgttcgttaccttcgtacccttccccgttacccgtccgttaagttcg

SEQ ID NO: 441262 - DNA, 588 bp, Homo sapiens
  misc_feature: GZ8MTXP01BFY67.11.57.F02.1.454.CMB.2.raw
  modified_base (204)..(204): a, c, t, g, unknown or other
  modified_base (260)..(260): a, c, t, g, unknown or other
  modified_base (281)..(281): a, c, t, g, unknown or other
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtacaaaatattaacaactacttagcctgtccaanagaacctgccaggctccagcncctnatctatgatgctagtttagggagggccacgtcggacactcccccaccccgtaggttcaggtggcgtaggtcgggtctcggggacagtacttcacttcctcaaccacgtcccgctacgcctagacgcctagaagtatttgcttagtttaattactgtacaacgagcgtagcagcggacggccgtcggcgtacgtcgcgaaggaccagggtagaacgtcaaggaacgtaacgttgggtacggctcggaccaccgttagttccgttaacgttcctttcacgttcccgttccctccgctttaaccgg

SEQ ID NO: 441263 - DNA, 535 bp, Homo sapiens
  misc_feature: GZ8MTXP01D6WFJ.11.57.F02.1.454.CMB.2.raw
  modified_base (261)..(261): a, c, t, g, unknown or other
  modified_base (281)..(281): a, c, t, g, unknown or other
  modified_base (284)..(284): a, c, t, g, unknown or other
  modified_base (354)..(354): a, c, t, g, unknown or other
  modified_base (359)..(359): a, c, t, g, unknown or other
  modified_base (372)..(372): a, c, t, g, unknown or other
  modified_base (393)..(393): a, c, t, g, unknown or other
  modified_base (422)..(422): a, c, t, g, unknown or other
  modified_base (528)..(528): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatataaacaactacttagctgtaccaanagaaacctgcagctccagcnctnatctatgatgcagtttaggagggccatggcatccccacaggtttcagtgcaggtggtctggacagacttnattcncaaccatcccganagcctagacgtcctagaagtntttgactagtttaattaactgtacaaacngacgtagcagcgacggcctaccgggcgtacgtcgacgaaggaaccaggtagaagtcaagtaacaagttgtgcgtgcaccgattctcgtactctatccttccgtccngttaacg

SEQ ID NO: 441264 - DNA, 590 bp, Homo sapiens
  misc_feature: GZ8MTXP01AU1ZX.11.57.F02.1.454.CMB.2.raw
  modified_base (262)..(262): a, c, t, g, unknown or other
  modified_base (285)..(285): a, c, t, g, unknown or other
  modified_base (371)..(371): a, c, t, g, unknown or other
  modified_base (381)..(381): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggtccaanagaaacctggccaggctccagcncctcatcatgatgctatttaggaggccatcggcactccccaccaggttcaggtggctaggtggtctgggacagacttcattcctcncagtcccganacgcctagacgcctagaatattttgacttagtttattactgtacaacagcgtagctagcgacggccgtccgggacgtaaacggttccggaccgaacggggacccgtaagggtacggaaacgtaccgaagtcggaaacgttggtcgggctcggaccaccttagttccttcggttccttctaccgttccgttccccggtcgttaacttccg

SEQ ID NO: 441265 - DNA, 724 bp, Homo sapiens
  misc_feature: GZ8MTXP01D7DA6.11.57.F02.1.454.CMB.2.raw
  modified_base (242)..(242): a, c, t, g, unknown or other
tcagcgagagataccacgaccggtgctcgatttagctcgatatagttgggtttggggcagggtgtacacctgtggttctcggggctgccctttggctttggagatggttttctcgagtgggggctgggagggtctttgttggagaccttgcacttgtactccttgccattcagccagtcctggtgcaggacggtgaggacgctgaccacgacggtacgtgcttgttgtactgcctcctccgngtctttgtcttggctattatcgcctaccctcccgaccgtcccgtacctaccgtaactagtacgtaacttcgacccgtcggtacgggttcttccggcggtcctacccgtacccgtaccccaacccaccaccggtcaacgttcggtacccgtacccgtacgggaccgggggtcccacgacggtacctaccccgggaagggggtaacggggtctaaggggtaactgggttaactttcaaacttaacgtaagttaccgagtaagggttacggtacgggtacgaccgtaaacctattaacgtaccgtacgacacgttactcgtaggttacgggaaaccggtacttacttacgtactactacttaccaacgaagaacgaacaagtaccgaaacaaaccctactacctaagttaacttatacgttaaacgaaactacaaacgcgccgtaaggacgaacgtacgggaacgacgtaaccggtttaataagg

SEQ ID NO: 441266 - DNA, 567 bp, Homo sapiens
  misc_feature: GZ8MTXP01BLHUW.11.57.F02.1.454.CMB.2.raw
  modified_base (262)..(262): a, c, t, g, unknown or other
  modified_base (287)..(287): a, c, t, g, unknown or other
  modified_base (437)..(437): a, c, t, g, unknown or other
  modified_base (539)..(539): a, c, t, g, unknown or other
  modified_base (544)..(544): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggtccaanagaaacctgcaggctccagctcctnatctatgatgctagtttaggagggccagtggcactccccaccgaggttcaggtgcaggtgggtctcgggacagtacttcattccacaaccatcccgcacgtcctagacgtcctagaagttatttgacttagttttattaacgtgtacaanagcgtagcgacgcgacggtcccgtccgggcgtaccggttccggaccgaaacgggaccgaagggtggaagtcgaaggcgtaagttggtggcgtagcaccgttnttctnttctctctccgttcctcttgtcg

SEQ ID NO: 441267 - DNA, 573 bp, Homo sapiens
  misc_feature: GZ8MTXP01DG3CM.11.57.F02.1.454.CMB.2.raw
  modified_base (203)..(203): a, c, t, g, unknown or other
  modified_base (376)..(376): a, c, t, g, unknown or other
  modified_base (432)..(432): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaaacaactacttagcctggttccaacagaaacctggccaggctcccaggctcctcatctatgatgctagtttaggagggccactggcactccccaccaggtttcagtggcaggtggtctgggacagtcttcattcctacncctatcccgcacgcctagacgcctagaagtatttgactagtttatacgtgtacaanagcgtaagctagcgacggccgtccggcgacgttccggaccgaagggaacccgaaggtaggaacgtcgaaagaacgaaacgttggtacgggctcggccaccgttattccgtgttacttcacttcccttcccgccgttaatcg

SEQ ID NO: 441268 - DNA, 621 bp, Homo sapiens
  misc_feature: GZ8MTXP01BENPE.11.57.F02.1.454.CMB.2.raw
  modified_base (285)..(285): a, c, t, g, unknown or other
  modified_base (378)..(378): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccagcncctcatctatgatgcagtttaggacgggccacgtggccactccccaccgaggtttcagtgcgaggtgggtctcgggacagacttcattctccncatcccgcacgcctaggacgtccgtagtaagtattttgaccttaagttttattacgtgtacaacgagacgtagcagcgacggtcccgtccgggcgtaccggttccggaccgaaacgggaacccgtaagggtaggaacgtacgaacggtaacgaaacgttggtcgggttacacggccacccgttagttccgttcgttcctttaaccgtaccgtttccccttaccccggtccttaacgtttcccg

SEQ ID NO: 441269 - DNA, 701 bp, Homo sapiens
  misc_feature: GZ8MTXP01BAFWO.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggtccaacagaaacctggccaggctcccaggctcctcatctatgatgctagtttagggacgggcccacgtggcactccccgacccgtagggtttcacgggttggcctagggtcggggtcgtcgggggacctaggtaccttctaatttccctacgcccagtcccgacacgtcccgttaaggacgtcccgtagtaaaggttatttttaggacttaacgttttatttaacgtgttacaacgtaggacgttacgacacggccggaacggccccggttacccgggaccgggtaccgggttacccggggacccggaaaacgggggtaacccgaaacgggggttacggaaacggtaccggaaacgggtaacgaaaccggttgggttcgggctacggccttacccgttattccgtgttcccttcgtacctttcccgttacccgccttaagttccg

SEQ ID NO: 441270 - DNA, 626 bp, Homo sapiens
  misc_feature: GZ8MTXP01D62YU.11.57.F02.1.454.CMB.2.raw
  modified_base (264)..(264): a, c, t, g, unknown or other
  modified_base (286)..(286): a, c, t, g, unknown or other
  modified_base (572)..(572): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttaccaanagaaacctgccaggctccagcnctcatctatgatgctagtttaggacggggccactggacactccccacctagggtttcaggttggcaggtgggtcgtgggactagacttcgattcctcaaccatcccgcagcctagagtcctagaagtatttgacttagtttacttaacttgtactaacagtcgtagcagtcggaacggtcctccgggacgtaccggttccggaccggaacggggaaacccgtaagggtagggtaacgtaccgaagggaacccgtaaagttcgggtacggctacgggccttaaccgnttaccgtggtttacccttaacgtacttcccttccccgtaacgttaacgttaacg

SEQ ID NO: 441271 - DNA, 763 bp, Homo sapiens
  misc_feature: GZ8MTXP01AZTM6.11.57.F02.1.454.CMB.2.raw
  modified_base (204)..(204): a, c, t, g, unknown or other
  modified_base (293)..(293): a, c, t, g, unknown or other
  modified_base (424)..(424): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttaccaacagaaacctggccaggcctccagctcctnatctatgatgactagtttagggacgggtccaacgtgggacctaacgttcccccgaacccgtagggtttaccaggttcggaccgtaggttcggggtcgtacggggactagtacttcactttaccacaaccgntcccgacgtacgacccgtagacgtcctagtaaagttacttttacgacgttaaagttttaacttaacgtacggttaacccaaagacggtaccgttaagaccgaaaggtcccggaaacggggtccccggtacccgggtaccgggtaacccgggtttacccgggaaccccgggtaaacgggggaaacccgtaaagggggttaccggggaaacttaccgggaaaggtaacggtaaacgttggggtaacgcgttaccgggacccttaaaccggttcttccgggttaacgttcccgtttaacctaaccgttcccttttaccccggaaccgttaacgtttcccggg

SEQ ID NO: 441272 - DNA, 544 bp, Homo sapiens
  misc_feature: GZ8MTXP01A8M4Y.11.57.F02.1.454.CMB.2.raw
  modified_base (260)..(260): a, c, t, g, unknown or other
  modified_base (284)..(284): a, c, t, g, unknown or other
  modified_base (328)..(328): a, c, t, g, unknown or other
  modified_base (363)..(363): a, c, t, g, unknown or other
  modified_base (365)..(365): a, c, t, g, unknown or other
  modified_base (381)..(381): a, c, t, g, unknown or other
  modified_base (414)..(414): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcaggccagtacaaaatattaacaactacttagcctgtccaanagaaacctggccaggctccaggcncctcatctatgatgctatttaggagggccagtggcatcccaccnggttcagtgcagtggtctgggacagacttcattcncncatccgcagcctagancctagaatatttgctagtttatactgtacaacngctagcagcgacggcctccggacgtacggtcgaccgaagggaccaaggtggaaactcgaaaggcgaaacgttgggtacggctacggcaccgattcgtaagttcttcacttccttccccgaacttaattcg

SEQ ID NO: 441273 - DNA, 778 bp, Homo sapiens
  misc_feature: GZ8MTXP01BOR0X.11.57.F02.1.454.CMB.2.raw
  modified_base (263)..(263): a, c, t, g, unknown or other
  modified_base (285)..(285): a, c, t, g, unknown or other
  modified_base (287)..(287): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaacaactacttagcctggttccaanagaaacctgccaggctccagcncnatctatgatgctagtttaggaggccaacgtggaccactcccccgaaccgtaggtttcaaggttcggacgtagggttcggggtacctagggggacctaaggtacctttcgaactttccctaccaacccgtaacgttccccggactacgacccttaaggacgtcccttaaggaaacgttatttttacggacctttaaagtttttaactttaaccgttacggttaacctaaaacgtacggtaccgttaacgacgtaacggaccgggtaacggggtaccccgttccccggggaccggtaaccgggtttcccgggaacccggtaaaacgggggtaaacccggaaaggggttacgggtaaaacggttaccgaaaacgggtaacggtaaaaccggttgggtaacgggttccgttacggacccttaaccgttactttcccgttcggttacctttaacgtaacctttcccgtttacccccgaacgttaacgtttaacccg

SEQ ID NO: 441274 - DNA, 620 bp, Homo sapiens
  misc_feature: GZ8MTXP01EI5PX.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctggttccaacagaaacctgccaggctcccaggctctcatctatgatgctagtttaggagggccagtgcatccccaccaggttcagtgcaggtggtctgggacagtacttcattcctcaaccatcccgcacggcctaagcgcctagaatatttgactaagttttattactgtacaactagacgtagcaaggcgacggtcccgtccggacggtaccgttccggaccgaaagggaaccgaagggtaggaagtacgaaaggaaccgtaaacgttggacgggttcctacggacccttaaaccgttatttccgttaacggtttacctttccgtaacgtttccccgttacccccgtcccgttaaagtttcccgg

SEQ ID NO: 441275 - DNA, 604 bp, Homo sapiens
  misc_feature: GZ8MTXP01EPXUM.11.57.F02.1.454.CMB.2.raw
  modified_base (204)..(204): a, c, t, g, unknown or other
  modified_base (295)..(295): a, c, t, g, unknown or other
  modified_base (389)..(389): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaaatattaaacaactacttagcctggttaccaacagaaacctggccaggcctcccaggctccncatctatgatgctagtttaggagggcccagtggcactccccacccgtaggtttcaggttggctaggtggggtctggggacagtacttcattccncaaccatcccgcagccctagacgtcctagaagtatttgactagtttattactagttacaacagcgtagcacgcggacggtccgtccgggcgtaccggttccggaccggaagggaaccgaaggtagggaacgtacgaaggcggaaacgttggtacggcgtacggccaccgttgttcgttcgttcctttcacgttcccttacccgtccttaacttcg

SEQ ID NO: 441276 - DNA, 827 bp, Homo sapiens
  misc_feature: GZ8MTXP01B0D8T.11.57.F02.1.454.CMB.2.raw
  modified_base (205)..(205): a, c, t, g, unknown or other
  modified_base (261)..(261): a, c, t, g, unknown or other
  modified_base (281)..(281): a, c, t, g, unknown or other
  modified_base (283)..(283): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccaccctctcctgcagggccagtacaaaatataacaactacttagctagtcaanagaacctgcaggctccagcncncatctatgatgctaagtttagggacgggccacgttcggacctaacgtccccctaacccgtagggtttaccaagggtcgggaccgtaggggttcgggggtcgttacgggggaacctaggtaacctttctaacttttcccaacccaacccgtacgttacccccggacgtaaccggtaccccgttaagggaaccggttacccgttagggttaaaacgtttaacgttttttcggtaacccgttttaaaggttttttaacttttaaacccggttacggttaaacctaaacccgtagggtaaccccgttaagggaaccgtaacgggtaccgggaaacccgggggtcccccgtttacccgggggaaccgggttaacccgggtttaccccggggaaacccgggtaaacgggggaaacccggtaaaggggttacgggaaacgtacggaaacggtaacggtaaacgttgggtacggttcgtaccggacttaccgttgttaccgtttcggttaccttaacctacgttccccgttacccggtcccttaagtttccg

SEQ ID NO: 441277 - DNA, 554 bp, Homo sapiens
  misc_feature: GZ8MTXP01C80RO.11.57.F02.1.454.CMB.2.raw
  modified_base (289)..(289): a, c, t, g, unknown or other
  modified_base (525)..(525): a, c, t, g, unknown or other
  modified_base (549)..(549): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttaccaacagaaacctgccaggctcccaggcncctcatctatgatgcagtttaggagggccactggcactcccacctaggtttcagtggcaggtgggtctcgggacagcttcattcctcaaccatcccgacacgcctagacgcctagaagtatttgctagttttatactgtacaacagcgtagacagcgacggcccgtccggacgtacggtccggacgaagggaccgaaggtaggaagtcgaagaacgaacgttgtcgcgtcgcacgnttactgtctcgtctccttcccgcngttcg

SEQ ID NO: 441278 - DNA, 566 bp, Homo sapiens
  misc_feature: GZ8MTXP01BSUHE.11.57.F02.1.454.CMB.2.raw
  modified_base (238)..(238): a, c, t, g, unknown or other
  modified_base (352)..(352): a, c, t, g, unknown or other
  modified_base (405)..(405): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccgnggtcttttgcttggcattatgccaccctccacgcccgtccacgtaccagtgaacttgacctcagggtcttcgtgctcacgtccaccaccacgcatgtcgacctcgaggggtccncaggctccgagggtagggctggaatggatttcatacattagctagtagtggtncgacatatactacgacagactcgtgtgaacgggcctatttcgaacttcaacttcctaccaagacgaacaaagtcggaccaaacaactcgaacttgttatcgttaggaaactcaaacgcgccgtaagagtaacggtcggaaggaccgtaacgggttcttaag

SEQ ID NO: 441279 - DNA, 552 bp, Homo sapiens
  misc_feature: GZ8MTXP01CTRD7.11.57.F02.1.454.CMB.2.raw
  modified_base (262)..(262): a, c, t, g, unknown or other
  modified_base (374)..(374): a, c, t, g, unknown or other
  modified_base (397)..(397): a, c, t, g, unknown or other
  modified_base (438)..(438): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcagtttaggagggccacgtggcatccccaccaggtttcaggtgcaggtgggtctcgggacagtacttcattcncaaccatcccgcagccctagacncctagaagtatttgctagtttatactgtacaacagcgtaancgagcgaggccctccggacgtacgttcggaccgtaagggaccaaggtggaacgtcgaagcgaacgttgtcggctgccaccagttctgtcttcacttccttcccgcttaagttcg

SEQ ID NO: 441280 - DNA, 549 bp, Homo sapiens
  misc_feature: GZ8MTXP01DX0OV.11.57.F02.1.454.CMB.2.raw
  modified_base (367)..(367): a, c, t, g, unknown or other
  modified_base (509)..(509): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggccggggggtcctgagactctcctgtctagtctctggattcgctcagtgactatgccatgaagtcgggtccgcaggcctcgagggtaaggggctaggaatggatttcatacattagcagtagtgtcgacgactntatactacgcagactcgtgtgaagggctatcatcatctcagagacaatcgacaacgaactctactagtaactctaaggaaactacaacgcgacctagaaggaaggtacggacggacacgggtactagttaattgttattggngtaacggacgaccggaccccgtaagggttcgtaacccggg

SEQ ID NO: 441281 - DNA, 680 bp, Homo sapiens
  misc_feature: GZ8MTXP01CKFZ8.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacagtccaccctctcctgcagggccagtacaaaatattaaacaactacttagcctggttccaacagaaacctggccaggctcccaggctcctcatctatgatgctagtttaggacgggccacgtggccactccccaccgtaggtttcaggtcggcgaggtgggtctacggggactaggtacttcacttcctaccaaccactcccgcaacgcctaaggacgtccctagtaagttattttgaccttaagttttacttacgttggtaacaacgtacggtacgtaagcgaacggacggacgggtccccgttaccggggaccgtaaccggttaccgggacccgaaagggggacccgtaaaggggtcggaaacgtacgaaaggccgtaaacgttgggtacggacgttcggaccttaaccgttagttccgtcggttaccctttaacgtaccgtttcccgtttaccccggaacttaacgtttccgg

SEQ ID NO: 441282 - DNA, 634 bp, Homo sapiens
  misc_feature: GZ8MTXP01AUN5D.11.57.F02.1.454.CMB.2.raw
  modified_base (307)..(307): a, c, t, g, unknown or other
  modified_base (370)..(370): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcttagtccgaggccggggggtcctgagctctcctgtctagtctctggattcgcctcagtgactatgccagtgaagtgggtcccncgaggctccgagggtaaggggctaggaatggatttcatacattagctagtagtgtgacgaccntatactacgcagactcgtgtagaagggtcccgtatttacgatcgtaactcctaccaagagaactaaagtcggaccaaaacgtaacctacctaaccttaggttaaactacgttaaggaaaacttcccgaaaacgcggtaaccctggaaagaacgggttaccggaaagggtaacccgacgggttaccgttaggttaaatttagtttagttcggtggaaccgtacgggaccccggttacccccggtgggttaaccgggtaacccggg

SEQ ID NO: 441283 - DNA, 573 bp, Homo sapiens
  misc_feature: GZ8MTXP01C9DPO.11.57.F02.1.454.CMB.2.raw
  modified_base (203)..(203): a, c, t, g, unknown or other
  modified_base (288)..(288): a, c, t, g, unknown or other
  modified_base (372)..(372): a, c, t, g, unknown or other
  modified_base (374)..(374): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaaatattaacaactacttagcctggttaccaacagaaacctggccaggctccagctccnatctatgatgctagtttaggagggccactggctactccccaccaggttcagtggcaggtgggtctcggggacagcttcattccncnccatcccgctacgcctagacgcctagtaagtatttgcttagtttattactgtacacagcgtagcagcgacgccgtccggcgtacgttcggaccgaacgggaaccgaagggtcggaagtcgaaaggcgaaacgttggtacggcgtacgcaccgttcttacgttgttaccttctacttcccttacccgtccttaagttccg

SEQ ID NO: 441284 - DNA, 632 bp, Homo sapiens
  misc_feature: GZ8MTXP01EZDRA.11.57.F02.1.454.CMB.2.raw
  modified_base (206)..(206): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactacttagctggttaccaacagaaacctggccaggctcccaggctcctcatctatgatgctagtttaggcggccacgtcggcctactccccacccgtaggtttccaggttcggactaggtcggggtcgttacggggacagtaccttacactttccacctaacccatcccgacacggtcccttaagggacgtacccgtagtaacgttattttacgacttaagttttacttacgtgtacaagagcgtaagctagcgacggtcccgtccgggacgtacggttccggaaccgagggaacccgagggtaggaacgtcgaagcgtaaagttggtacggttcgcgcaccgttattccgttgtcttaacgtctcccgttccgtcttaacttcg

SEQ ID NO: 441285 - DNA, 744 bp, Homo sapiens
  misc_feature: GZ8MTXP01AW4AN.11.57.F02.1.454.CMB.2.raw
  modified_base (205)..(205): a, c, t, g, unknown or other
  modified_base (286)..(286): a, c, t, g, unknown or other
  modified_base (330)..(330): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactactagcctggtaccaacagaaacctgcacgctccagcnctcatctatgatgactagtttagggacggccacgtcgacctacnccccaccgtaggttcagggtcgacgtagggttcgggtcgtacgggactacgtacttccgactttccctacaaccctacgtcccgacgtaccgtccgtaacggacgttacccgttaggtaaagttttacgttttacggaactttaaggttttttaacttaccgttacgtaaaccaacggtaggtaccgtaacggacgtaacgggtccggtaaccggggtcccccggttaacggggaccccgggttaaccggttcccgggaaaccggaacgggggtaaaccggtaaggggttaacgggaaacgttaacggaaacgggtaaccgtaacggttcgggttacgacgtcggtaccttaaccgttcgttccgttaagttccttaacctaccgtttccccgaccgtaaccttccgttaacgg

SEQ ID NO: 441286 - DNA, 531 bp, Homo sapiens
  misc_feature: GZ8MTXP01D9PPE.11.57.F02.1.454.CMB.2.raw
  modified_base (361)..(361): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccaggccggggggtccctgagactctcctgtctagtctctggattcgctcagtgactatgccatgaagtggtccgcaggctcgaggtagggctggaatggtatttcatacattacgctaggtagtggtgcgacntatactacgcagactctgtgaggcgattcatcatctaccagagacatgacaacgaactcaacttgtatcgtaggaactacaactagcctagagaagtcggaaggacaacgggcttaggttattagtttagttgagtcgacggaccgttccccgtaacggcgtaacccggg

SEQ ID NO: 441287 - DNA, 619 bp, Homo sapiens
  misc_feature: GZ8MTXP01AILYP.11.57.F02.1.454.CMB.2.raw
  modified_base (204)..(204): a, c, t, g, unknown or other
  modified_base (213)..(213): a, c, t, g, unknown or other
  modified_base (260)..(260): a, c, t, g, unknown or other
  modified_base (283)..(283): a, c, t, g, unknown or other
  modified_base (379)..(379): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctntcctgcaggccagtcaaaatattaacaactacttagctggttccaanagaaacctgcaggctcccaggcncctcatctatgatgctagtttaggagggtccactggcactccccaccaggttcagtggcaggtggtctgggacagctcattcctcaaccatcccgnaagccctagacgtccgtagaagtacttttgcttaagtttacttactagttacaaacaggcgttaagctaacggccgtaacggggtccccgttcccggggaccgtaacccggttccggacccggaacggggaacccgtaaaggggtcggaaacgttcgaaacggtcggaaacgttggacgggccttggaccaccgacttcgtgttaccttctacgttcccttcccgtaacttaacgttccg

SEQ ID NO: 441288 - DNA, 599 bp, Homo sapiens
  misc_feature: GZ8MTXP01EKQTK.11.57.F02.1.454.CMB.2.raw
  modified_base (205)..(205): a, c, t, g, unknown or other
  modified_base (262)..(262): a, c, t, g, unknown or other
  modified_base (282)..(282): a, c, t, g, unknown or other
  modified_base (284)..(284): a, c, t, g, unknown or other
  modified_base (378)..(378): a, c, t, g, unknown or other
  modified_base (385)..(385): a, c, t, g, unknown or other
  modified_base (413)..(413): a, c, t, g, unknown or other
  modified_base (552)..(552): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctcctggggaaacngtccaccctctcctgcagggccagtacaaatattaacaactactagcctgtaccaanagaacctgcaggctccagcncnatctatgatgctagtttagggacgggccagtcggcactccccaccgtaggtttccaggtcggcaggtggggtctcggggacagacttcattccncaacctntcccgacacgcctagacgtacctgaatntttgacttagtttattacgtgtacaacgagcgtagactacgcggacggtcccgtcggcgtacggttcgaccgaagggtaaccgagggtaaggaagtacgaacggaacgtaacgttggtacgggctacggccaaccgttnttcgtaacgttccttaacgtacttcccgttcccgaacttcgtaaccg

SEQ ID NO: 441289 - DNA, 820 bp, Homo sapiens
  misc_feature: GZ8MTXP01AVDMI.11.57.F02.1.454.CMB.2.raw
  modified_base (204)..(204): a, c, t, g, unknown or other
  modified_base (280)..(280): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatataacaactacttagctggtccaacagaacctgcaggctccagcnctcatctatgatgctagtttagggacggggtccacgtcgggaccaacttcccccgaaccccgtagggtttccaagggttcgggacctaaggggttcgggggtacgttacgggggaactaacggtacctttaccgtaacttttaccctacccgtaacccctaacgtttcccccggaccgtaaccggtaccccgtttaaagggaaaccgggtccccgtttaagggtaaaacggtttacgtttttttacgggaacgtttaaacgggtttttttaaactttaaacccggtttacgttaaccgtaaaccgtaacgggttacccggttaaggaccgttaacggacccggggtaaacggggtcccccgttcccggggtacccgggttaacccggtttcccggggaacccgtaaacgggggaacccgtaaaggggttagggaaacggtcgaaacgggaacgtaaaccgttgggttacggcgttacggccaccgttagttccgttaacggttcttaacgtacttcccgttacccgtccgttaacttccg

SEQ ID NO: 441290 - DNA, 531 bp, Homo sapiens
  misc_feature: GZ8MTXP01AJN3A.11.57.F02.1.454.CMB.2.raw
  modified_base (202)..(202): a, c, t, g, unknown or other
  modified_base (233)..(233): a, c, t, g, unknown or other
  modified_base (260)..(260): a, c, t, g, unknown or other
  modified_base (289)..(289): a, c, t, g, unknown or other
  modified_base (364)..(364): a, c, t, g, unknown or other
  modified_base (376)..(376): a, c, t, g, unknown or other
  modified_base (504)..(504): a, c, t, g, unknown or other
  modified_base (514)..(514): a, c, t, g, unknown or other
tcagcgagagataccacgaccggtgctcgatttagctcgatatagttgggtttgggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatnttaacaactacttagcctggttccaanagaaacctggccaggctcccaggctcctnatctatgatgcatttaggaggccatggcatcccaccaggttcagtgcagtggtctgggacagactttcatttccncaaccatcccgnagcctagatccctgaagtattttgctagtttatactgtacaacagcgtagcagcgacggcctcggcgacgttcggcgaacgggaccgaaggtggaacgtcgaagcgaacgttgtcggacgtgcaccgnttctgtctcnctcttcccgcttaatcg

SEQ ID NO: 441291 - DNA, 580 bp, Homo sapiens
  misc_feature: GZ8MTXP01ASGB5.11.57.F02.1.454.CMB.2.raw
  modified_base (204)..(204): a, c, t, g, unknown or other
  modified_base (385)..(385): a, c, t, g, unknown or other
  modified_base (395)..(395): a, c, t, g, unknown or other
  modified_base (403)..(403): a, c, t, g, unknown or other
  modified_base (441)..(441): a, c, t, g, unknown or other
  modified_base (537)..(537): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactactagctggttaccaacagaaacctggccaggctcccaggctcctcatctatgatgctagtttaggagggccacgtggcactcccccaaccgaggtttcaggtggcgtaggtgggtctcgggacagtacttcattctcncctatcccgnacgctagncctagaacgttatttgcttaagtttatactgtacaacngacgtagctagcgaggcccgtccggaccgacgttccggacgaagggaccaagggtggaacgtcgaaggcgtaacgttggtacggcgttcgcaaccngttccgtgttcctaactacgttcccttccccgaacttaacgtg

SEQ ID NO: 441292 - DNA, 795 bp, Homo sapiens
  misc_feature: GZ8MTXP01AZQ49.11.57.F02.1.454.CMB.2.raw
  modified_base (207)..(207): a, c, t, g, unknown or other
  modified_base (269)..(269): a, c, t, g, unknown or other
  modified_base (294)..(294): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcagggccagtacaaaatattaaacaactacttagcctggttaccaanaagaacctggcaggctccagctccncatctatgatgctaagtttagggacggccacgtcggcactccccgaccgtaggtttccaaggtcggacgtagggttggggtacgtacggggaactacggtacctttacgtaactttccctacctaaccctacgttcccgggacctaacggtaccccgttaagggaaccgtcccgttaaggtaaacgtttacgtttttcggaaccgttttaagtttttaacgtttaacgtacgggttaaccaaacggtacgggttaccgttaacggaccgaacgggcccgggtaacggggtcccccggtttaccggggacccgggttacccggggttaacccgggaacccgggtaaacgggggtaaaccccgtaaagggggttacgggaaacggttaccgaaacgggtaacccggtaaacggttgggtaaccggcgttaccggaaccgttaaccttcgttaccgttcgttaccttccgtaacttcccgttaccccgtcttaacgtttaacgg

SEQ ID NO: 441293 - DNA, 861 bp, Homo sapiens
  misc_feature: GZ8MTXP01BJMSJ.11.57.F02.1.454.CMB.2.raw
  modified_base (205)..(205): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactacttagcctggttaccaacagaaacctggccaggctcccaggctcctcatctatgatgactagtttagggacgggccacgtggccactaccccgacccgtagggtttcagggtcggaccgtaggggttcgggggtccgtacgggggaacctacggtacctttacctacttttacccctaccaacccgtaacgttccccggaccgtaacggtaccccgttaacgggacgtacccgtttaagggtaaaacgtttaacgttttttacgggacctttaaagggttttttaaactttaaccgtttacgggtttaaaccaaaaccggtacggtacccggttaagacccgttaacgggtaccggggaacccggggtccccggttaccccgggggtacccgggttaacccggggtttacccgggggaaaccccgggaaaacggggggtaaaccccgggtaaaagggggttacgggggtaaaaaccggttacccggaaacggggtaacccggtaaaacggttcgggggttacggaccgttacgggacccttaacccgttagtttccggttaacgttccctttaacctaccgttcccgttcccccgtaacttaacgttcccgg

SEQ ID NO: 441294 - DNA, 646 bp, Homo sapiens
  misc_feature: GZ8MTXP01DPNOW.11.57.F02.1.454.CMB.2.raw
  modified_base (203)..(203): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcaggccagtacaaatattaacaactacttagcctgttaccaacagaacctggccaggcctcccaggctcctcatctatgatgactagtttaggacgggccacgtcggaccactccccaccgtaggttcaggtgcgaggtggtcgtcgggacagtacttcacttcctacaaccactcccgacacgacccgtagacgtacctagtaaagttacgttttagactttaagttttaacttacgttgtaacaaacgtacgacgttagacgtacgcggacggtccccgtcccgggacgtaccggttaccggaccggtaaacgggaacccgaagggtacggaacgtaccgaaggaacgtaacgttggtacgcgtacgaccttaccgttacttcgtgttacccttcgtaccttccttaccccgtcttaacgtaaccg

SEQ ID NO: 441295 - DNA, 579 bp, Homo sapiens
  misc_feature: GZ8MTXP01DIBIQ.11.57.F02.1.454.CMB.2.raw
  modified_base (204)..(204): a, c, t, g, unknown or other
  modified_base (263)..(263): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctggttccaanagaaacctgcaggctccaggctctcatctatgatgctatttaggagggccacgtggcatccccacccgaggtttcagtggcaggtgggtctgggacagtcttcattcctcaacatccgcagccctagacgcctagaagtatttgacttagtttattaacgttgtacaacgagcgtagacagcgacggccgtcggacgacggttcggaccgtaagggaaccgaaggtacggaagtcgaaaggtcgaaacgttggtacggctacggcttacccgttattccgttgtactttccaattccgttccccgtcgaacttccg

SEQ ID NO: 441296 - DNA, 631 bp, Homo sapiens
  misc_feature: GZ8MTXP01B8WBA.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgcttattttagaaggtgtccagtgcgaggtgcaaggtggtgcagtcgtgggggagtcttaggtccgaggcccggggggtccctgacgactctcctgtctagtctctggattcgccttcagtgactatcgccatgaagtcgggtccgccgaggcctccgagggtaaggggctagggaatggtatttcgatactattacgctaggtagtggtcgacgaacctaagtactaaccgtacgcgagtactcgtagtcggaaagggccctattccatcaacttccaccagacgacaaagtcggaaccaaacgtaaccttcaaccgttagtaaacttccgtaaggaaaacttaccgaaaccacggtaccctaggaagtaacggttccggagggtaaccacgggtacttagttaatttagttacgttggtcgaaccgtagacccgttacccccgttaagggttcgaaccggg

SEQ ID NO: 441297 - DNA, 733 bp, Homo sapiens
  misc_feature: GZ8MTXP01CXTKP.11.57.F02.1.454.CMB.2.raw
  modified_base (207)..(207): a, c, t, g, unknown or other
  modified_base (304)..(304): a, c, t, g, unknown or other
  modified_base (308)..(308): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctccgtaggggaaacngtccaccctctcctgcgagggccagtaacaaaaattattaaacaacttacttagccttggttaccaacaacgaaacctggccaggcctcccgaggcncctnatctatgatgactagtttaggacggccacgtcggacacctaccccacccgtaggttcaggttggacgaggttggggtcgtacggggactaggtaccttctaactttcctaccaacccgtactcccggacacgaccgtaacggacgtccctaggtaaacgttagtttggactttaaggttttaacttacgttacgtaacaaacgagtaccgtaagcgaacgacgggtaccgggtcccgtaccgggaccggtaaccgggttcccggaacccggaaacggggtaaacccggtaaaggggtaccgggtaaacgtacgaaagggtaacccgtaaaggttcgggtaacggttcgtacggaacccttacccgttagttcccgttcgttaccttaaccgtacttcccgttcccgaacccttaacgttaaccgg

SEQ ID NO: 441298 - DNA, 609 bp, Homo sapiens
  misc_feature: GZ8MTXP01ALRZM.11.57.F02.1.454.CMB.2.raw
  modified_base (207)..(207): a, c, t, g, unknown or other
  modified_base (265)..(265): a, c, t, g, unknown or other
  modified_base (277)..(277): a, c, t, g, unknown or other
  modified_base (280)..(280): a, c, t, g, unknown or other
  modified_base (283)..(283): a, c, t, g, unknown or other
  modified_base (285)..(286): a, c, t, g, unknown or other
  modified_base (288)..(288): a, c, t, g, unknown or other
  modified_base (290)..(292): a, c, t, g, unknown or other
  modified_base (294)..(294): a, c, t, g, unknown or other
  modified_base (302)..(302): a, c, t, g, unknown or other
  modified_base (328)..(328): a, c, t, g, unknown or other
  modified_base (433)..(433): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctccgtaggggaaacngtccaccctctcctgcgaggccagtacaaaatataaacaactacttagctgtaccaanagaactgcagcnccngcncnntntnnngntagttggngcagtgcactcccacgtgtcagtgcnggtggtcgtggacagtcttcacttccaccaacctactcccggacacgtaccgtagacgtcctaggtaaattgtttcgactttaagttttatacgtgtacaaacgngtccgtagcgagcggtacgggcccgtcgggaccggtaccggtcggaccgaaacgggaccgaaggggtgtaaacgaccgaagggaaccgtaagttgggtcgggccttacggacccttaacgttcttcgttccgttccttaaccgacccgtttccccttacccgccttaagtttcccg

SEQ ID NO: 441299 - DNA, 624 bp, Homo sapiens
  misc_feature: GZ8MTXP01CNIYB.11.57.F02.1.454.CMB.2.raw
  modified_base (289)..(289): a, c, t, g, unknown or other
  modified_base (379)..(379): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaacttacttagcctggttccaacagaaacctggccaggctcccaggcncctcatctatgatgctatttaggagggccacgtggccactccccacccaggtttcagtggcaggtgggtctgggacagacttcattctcnccatcccgcacgcctagacgccctagaagtattttgacttagtttattacttgtactaacagcgtagcagcgacggtccctccgggcgtacggttccggaccgtaaacggggacccgaaggggtacggaaaggtaccgaaacggtccggaaacgttgggtacggcgttacggacccttaacccgttattccgttaacggtcccttttaacacgttcccgtttacccccgtccttaacgtttcccg

SEQ ID NO: 441300 - DNA, 662 bp, Homo sapiens
  misc_feature: GZ8MTXP01DAHAS.11.57.F02.1.454.CMB.2.raw
  modified_base (208)..(208): a, c, t, g, unknown or other
  modified_base (274)..(274): a, c, t, g, unknown or other
  modified_base (473)..(473): a, c, t, g, unknown or other
tcagcgagagataccacgaccggtgctcgatttagctcgatatagttgggtttggggaggaactgctcagttaggacccagagggaaccatggaaagccccagctcagctttctcttcctcctgctacactggctcccagataccaccggagaaatttgtgttgacacagtcctccggccaccctgtctgcgtctccgtggggaaacngtccaccctctcctgcagggccaagtcaaaaatattaaacaacttacttagcctaggttaccaaanagaaacctggccaggctcccgagctcctcatctatgatgctatttaggaggccatggcactcccaccgtagttcagtggcaggtggtctcgggacaggtacttcgatttacccacaaccatcccgactacgcccttaaggacgtccctagtaaagtacgttttgaacttagttttatacgttgtactaacgagcgtaancgaggcggaacggggtcccgttaccgggacgtaaccggttccggaaccgaacgggtaaacccgaggttacgggaaacgtacgaaacggaacgtaaaccgttggtcggaccttacggtaccaaacccgttcttacccggtctttaacccttcgtaacctttccccggttacccttccgttaacgtttccg

SEQ ID NO: 441301 - DNA, 585 bp, Homo sapiens
  misc_feature: GZ8MTXP01DQ5EU.11.57.F02.1.454.CMB.2.raw
  modified_base (240)..(240): a, c, t, g, unknown or other
  modified_base (308)..(308): a, c, t, g, unknown or other
  modified_base (349)..(349): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgnggtctttgcttggctattatgcacctccacgccgtcacgtaccagtgaacttgacctcgaggtctcgngctcacgtccaccaccacgcatgtcgacctcgaggggtccncaggcctccgagggtagggctggaatggatttcatacattagcaggtagtgtgacgaccatatactacgacagtactcgtaggtgaaacgggccgtattcgattcaactcctaccgaagacgaactaaacgtcggaaccaaactaactcaacttagttaactacgttaaggaaaacttcaaacgcgacccgttaaggaagtaacggtacggaacgggacgtaacgggttctttaag

SEQ ID NO: 441302 - DNA, 562 bp, Homo sapiens
  misc_feature: GZ8MTXP01AT9GY.11.57.F02.1.454.CMB.2.raw
  modified_base (263)..(263): a, c, t, g, unknown or other
  modified_base (367)..(367): a, c, t, g, unknown or other
  modified_base (372)..(372): a, c, t, g, unknown or other
  modified_base (532)..(532): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaanagaaacctggccaggctcccaggctcctcatctatgatgcatttaggagggccactggcatccccaccaggttcagtggcaggtgggtctggggacagtacttnattcncaaccatcccgcacgcctaagacgtccctagaagtattttgacttagtttattactgtacaacagcgtagcagcggacggtccgtccgggcgtaccggttcggaccgaagggacccgaagggtggaaagtcgaaagcgaacttggacggcgtagcaccgnttctgtctcactccttcccgtcttaatccg

SEQ ID NO: 441303 - DNA, 574 bp, Homo sapiens
  misc_feature: GZ8MTXP01AH7IK.11.57.F02.1.454.CMB.2.raw
  modified_base (354)..(354): a, c, t, g, unknown or other
  modified_base (419)..(419): a, c, t, g, unknown or other
  modified_base (534)..(534): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccgcggtcttttgcttggcattatgccacctccacgccgtccacgtaccagtgaacttgacctcgaggtcttcgtgctcacgtccaccaccacgcagtgtcgaccgtcgacggggtcccncgaggcctacccgagggtaggggctaggaatgggtatttcatacagttagctaggtagtgggtcncgacatactacctacgacagactcgtggtagaacgggccgtattcgattccacttacctaccgaagacgacaaagtcgaccaaacactcaacttgttatacgagaaactcaacgngcctaagagaacggtcggacggacgtaacggttcgttaag

SEQ ID NO: 441304 - DNA, 617 bp, Homo sapiens
  misc_feature: GZ8MTXP01C31GW.11.57.F02.1.454.CMB.2.raw
  modified_base (264)..(264): a, c, t, g, unknown or other
  modified_base (284)..(284): a, c, t, g, unknown or other
  modified_base (424)..(424): a, c, t, g, unknown or other
  modified_base (579)..(579): a, c, t, g, unknown or other
  modified_base (594)..(594): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacagtccaccctctcctgcagggccagtacaaaatattaaacaactattagctggtacaanagaacctgcaggctccagcnctcatctatgatgactagttaggacgggccagtcggcactccccaccgtaggttcaggtggactaggtcgggtctcggggacagtacttcacttctaccaaccactcccgactacgccgtaagacgtcctagtaaagttntttcgacttaagttttaattacgtacgtacaaacgagtaccgtaagcaaggtccgacggggtccctacgggccgaccggttaccggacgaaacggggtaccgaagggtggaaacgtcgaaacggtaacgaacggttggtaggctacgcaccgttnttcgttgtcttaacncgttcccttcccgcttaacgtcg

SEQ ID NO: 441305 - DNA, 651 bp, Homo sapiens
  misc_feature: GZ8MTXP01EA6JS.11.57.F02.1.454.CMB.2.raw
  modified_base (206)..(206): a, c, t, g, unknown or other
  modified_base (260)..(260): a, c, t, g, unknown or other
  modified_base (272)..(272): a, c, t, g, unknown or other
  modified_base (277)..(277): a, c, t, g, unknown or other
  modified_base (279)..(279): a, c, t, g, unknown or other
  modified_base (644)..(644): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtcctccggccaccctgtctgcgtctccgtaggggaaacngtccaccctctcctgcaggccagtacaaaatataacaactactagctgtacaanagaactgcagcncagcncnatctatgatgctagttaggacggccatcggcactccccgacctaggtttcaggtcggacgtaggtcggggtctacggggactaggtacctttcaatttcccacaacccgtactccccggacaacgtcccgtaaggacgtcccgtagtaaagttagttttcggacttaggttttaatttaacgtgttaacaacgtagacgtaacgactacggacggtaacggcccgtaccggaccggtaccggttacggaaccggaacgggtaaaccggtaaggaaggtaaacgtaccgaaagtaacgtaacgttagggtcggttctacggaccacttacttcgttcgtcttaaccacttcccgttacctccgttnttaaccg

SEQ ID NO: 441306 - DNA, 643 bp, Homo sapiens
  misc_feature: GZ8MTXP01B4PJQ.11.57.F02.1.454.CMB.2.raw
  modified_base (205)..(205): a, c, t, g, unknown or other
  modified_base (266)..(266): a, c, t, g, unknown or other
  modified_base (295)..(295): a, c, t, g, unknown or other
  modified_base (383)..(383): a, c, t, g, unknown or other
  modified_base (400)..(400): a, c, t, g, unknown or other
  modified_base (410)..(410): a, c, t, g, unknown or other
  modified_base (438)..(438): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactacttagcctggtaccaanagaaacctggccaggctcccaggctcctnatctatgatgctagtttaggagggccagtcggacactccccaccgtaggttcagtggcaggtgggtctgggacagtacttcattcacnccatccgcagcctagcncctgtaagtntttgactagtttattacgtgtacaacgngacgtacgacgacgtcggacggtccccgtccggaccggtaccggttacccgggaccgtaacgggaaccgtaagggtacgggaacgttaacgaaacggtaacggtaaaccgttgggtccggacgttacggaccttaacccgttacgtttccgtcggtttcctttccgtaaccctttcccgttacccccgtcccttaacgtttcccg

SEQ ID NO: 441307 - DNA, 768 bp, Homo sapiens
  misc_feature: GZ8MTXP01A06XH.11.57.F02.1.454.CMB.2.raw
  modified_base (204)..(204): a, c, t, g, unknown or other
  modified_base (386)..(386): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtcaaaatattaaacaactacttagcctggtccaacagaaacctggcaggctccaggctctcatctaatgatgctagtttaggacgggccaagtcggaccactccccacccgagggtttccaggtggctaggtggggtctggggacagtacttcaattccncaacctatccggacacggtcctaggacgtacccgtagtaacgttattttggaccgtttaggttttaaacttttaacgttaacggttacctaaaaccggtacgtaccggtttaacggaccgtaaacggtccggggtaaaccggggtcccccggttacccgggggaccccgggttaaaccggggttttaccccggggaaaccccgggtaaaacggggggtaaacccccggttaaaaggggggttaaccggggaaaacgggttaaccggaaaacgggaaccgggtaaaacggttcggggttacgggacgttcgggaccttaaccgttacgttcgttaacggtcctttaaccacgtttccccgttccccgtccttaacgtttcccg

SEQ ID NO: 441308 - DNA, 649 bp, Homo sapiens
  misc_feature: GZ8MTXP01CH0IG.11.57.F02.1.454.CMB.2.raw
  modified_base (260)..(260): a, c, t, g, unknown or other
  modified_base (278)..(278): a, c, t, g, unknown or other
  modified_base (280)..(280): a, c, t, g, unknown or other
  modified_base (286)..(286): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccacctctcctgcagggccagtacaaaatattaacaactactagctgtccaanagaactgcagctccagcncnatctangatgctagtttaggaggccagtggccactccccaccgaggtttcaggtggctaggtgggtcgtgggacagtcttacacttcctacaaccctatcccgacacgacctaggactcccgtagtaagtatttagacttaagtttaattacgttgtacaagtacgacgtagacgagcggaacgggtcccgtaccgggtaccgggtaccggttccgggaaccggaaacggggtaaacccggtaaaggggttacggaaacggttaccgaaagggtccggaaacgttcgggttacggcgttacggaccacccgttattccggtttgtacctttcgtaaccttcccgttaccccgtccttaacgtttaaccg

SEQ ID NO: 441309 - DNA, 580 bp, Homo sapiens
  misc_feature: GZ8MTXP01BCI6L.11.57.F02.1.454.CMB.2.raw
  modified_base (204)..(204): a, c, t, g, unknown or other
  modified_base (256)..(256): a, c, t, g, unknown or other
  modified_base (277)..(277): a, c, t, g, unknown or other
  modified_base (280)..(280): a, c, t, g, unknown or other
  modified_base (286)..(286): a, c, t, g, unknown or other
  modified_base (321)..(321): a, c, t, g, unknown or other
  modified_base (348)..(348): a, c, t, g, unknown or other
  modified_base (360)..(360): a, c, t, g, unknown or other
  modified_base (368)..(368): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaatataacaactatagcctgtccaanagaacctgcaggctccaggcnctnatctangatgcatttagggcgctgtgcactcccacgtcgtnagtcgcgaggtggcgtcggacagtctntacttcacaacnctccgacncgactagactccgtagaagttatttgacttagtttactacgtctactaacgagttacgagacgagtcggaacggtcccgccgggacgttacggtaccggaccggacgggaaccgagggttacggaacgtacgaaggtccgaaagttggtcggttcgtcgaaccacgttacttcttcggtctttcacgttcccttccgtaaccttaagttccg

SEQ ID NO: 441310 - DNA, 777 bp, Homo sapiens
  misc_feature: GZ8MTXP01AIIC0.11.57.F02.1.454.CMB.2.raw
  modified_base (258)..(258): a, c, t, g, unknown or other
  modified_base (293)..(293): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaacagtcaccctctcctgcaggccagtacaaatattaacaactactagcctgtccaanagaactgcacgctccacgcgcctcactctactagntgtctagtttaggtagggccgacgtacggcgactaccccacccgtacgttcgtacgtggcgacggtgggcggttttttttcgggacggaggtacttcgtattacttcctcccactacccgaccgacgtaccgtacgtacgtacgtacgtaacgttaatttacgttacgttacgtttaactttaacgttacgttacgtaaaccgtaacgttacggtaacgttaccgtacggaccgggacgggtacccggttaccccgggtacccggggtaacccgggtttacccgggggttaacccggtaaaccgggggaaacccgggaaaccggggtaacggggtaaacggttaaaccgggtaaacgggaaccgggtaaacggttcggtacgggttcggtaccggtaccggttaccccgttaaccggttaccttccggtttccggtttaacccgttaacgtttcccttaccggtttaaccttccgtttaaccgg

SEQ ID NO: 441311 - DNA, 608 bp, Homo sapiens
  misc_feature: GZ8MTXP01DNAY2.11.57.F02.1.454.CMB.2.raw
  modified_base (205)..(205): a, c, t, g, unknown or other
  modified_base (292)..(292): a, c, t, g, unknown or other
  modified_base (406)..(406): a, c, t, g, unknown or other
  modified_base (430)..(430): a, c, t, g, unknown or other
  modified_base (572)..(572): a, c, t, g, unknown or other
  modified_base (586)..(586): a, c, t, g, unknown or other
  modified_base (598)..(598): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtccaccctctcctgcagggccagtacaaaatattaaacaactacttagcctggttaccaacagaacctggcaggctccgagctccncatctatgatgactagtttagggacgggccagtcggcactccccaccgtaggtttcaggtcggcgtaggtgggtcgtagggactagtacttcatttccacaacctactcccganacgcctaggacgcctagtaagttntttgacttagtttattactgtacaacgagtcgtagcacgcggacggtcccgtccgggaccgtacggttccggaaccgaaaggggaaccaaggggtacggaagtaccgaaggaacgtaacgttggtcggcgtgcttaccgttnttcgtcgtacttcncttccgttcccncttaagttcg

SEQ ID NO: 441312 - DNA, 598 bp, Homo sapiens
  misc_feature: GZ8MTXP01C5NVA.11.57.F02.1.454.CMB.2.raw
  modified_base (290)..(290): a, c, t, g, unknown or other
  modified_base (292)..(292): a, c, t, g, unknown or other
  modified_base (461)..(461): a, c, t, g, unknown or other
  modified_base (562)..(562): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtaggggaaacagtccaccctctcctgcagggccagtacaaaatattaaacaactacttagcctggttaccaacagaaacctgccaggctccagcncncatctatgatgctagtttaggacgggccacgtggacactcccccaacccgtagggtttccaggtggctaggtgggtccgtaggggacagtaccttcacttcctacaaccgtactcccgacacgccctagacgcctagaagtatttgacttagtttactactgtacaacngacgtagacagcggacggtcccgtccggacgtacgttccggaccgaagggaccgaaggtggaagtcgaagcggtaacgttggtcggctacggccaccgttnttcgttcgtccttcacttccttcccgcttcgtaacg

SEQ ID NO: 441313 - DNA, 653 bp, Homo sapiens
  misc_feature: GZ8MTXP01BP1ZS.11.57.F02.1.454.CMB.2.raw
  modified_base (205)..(205): a, c, t, g, unknown or other
  modified_base (263)..(263): a, c, t, g, unknown or other
  modified_base (288)..(288): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctcctggggaaacngtcacctctcctgcagggccagtacaaaatattaacaactactagcctggttaccaanagaacctgccaggctccagctcctnatctatgatgctatttaggaggccatggcactcccaccaggttcaggtggcaggtgggtcgtgggacagtacttcgactttcacaaccatcccgacacgcccttaggacgtccttaggaagtattttgacttagttttattaactcgttacaaacgtagtacgttagacgacgaccggacggtccccgtaccgggtaccggaccggtttaccggacccggaaacggggtaacccgtaaaggggtcgggaaacgttacgaaacgggtaaccgtaaacggttcgggtcggttcgtacggtaccaaccgttaacttcgttcggttcctttcaaccgtttcccttaccccggtaaccttcgttaaccgg

SEQ ID NO: 441314 - DNA, 593 bp, Homo sapiens
  misc_feature: GZ8MTXP01AL96K.11.57.F02.1.454.CMB.2.raw
  modified_base (203)..(203): a, c, t, g, unknown or other
  modified_base (263)..(263): a, c, t, g, unknown or other
  modified_base (374)..(374): a, c, t, g, unknown or other
  modified_base (434)..(434): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttccaanagaaacctggccaggctcccaggctcctcatctatgatgctagtttaggacgggccacgtggcactccccaccgaggttcagtgcagtggtctgggacagtacttcattcncaaccatcccgacacgcctagacgcctagaacgtatttgcttagtttatactgtacaacngtctagcagcggacggtcccgtccggacgtaccgttcggaccgaaggggtacccgaagggtcggaaacgtacgaaggaacggaaacgttggtacgggttcctcggtaccacccgttattccgtgttccttcgtactccgtttccccgcgttaacttccg

SEQ ID NO: 441315 - DNA, 813 bp, Homo sapiens
  misc_feature: GZ8MTXP01B9IGW.11.57.F02.1.454.CMB.2.raw
  modified_base (206)..(206): a, c, t, g, unknown or other
  modified_base (263)..(263): a, c, t, g, unknown or other
  modified_base (284)..(284): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctccagataccacggagaaattgtgttgacacagtcctccggccaccctgtctgcgtctccgtaggggaaacngtccaccctctcctgcagggccagtacaaaatataacaacttactagctgtaccaanagaactgcagctccagctctnatctatgatgtactagtttagggacggccacgtcggaccacctaccccgaccgtaggtttcaagggttcggacgtagggttcggggtacgttacgggggaacctaggtacctttccgaacttttcccaacccgtaaccctacgttccccgacaaccggtacccgtaagggacgtacccgttaaggtaaacggtttactttttcggaccttttaaaggtttttaacttaaacccgttaggttaaaccaaacggtacgggtaacgttaacggaccgaacggtaccggggtaacccggggttccccggtaccccggggaccgggttaaccggttacccggggaaacccggtaaaccgggggtaaccggtaaagggggttacgggaaacggtaccgaaacggggtaaccgtaaacgggttcgggtacgggttcccttaacgggacccgttaacccgttacgtttacccgttcggtttaccctttccgttaacccgtttccccgttaccccggtaacctttaacgtttaaccgg

SEQ ID NO: 441316 - DNA, 628 bp, Homo sapiens
  misc_feature: GZ8MTXP01DLEE9.11.57.F02.1.454.CMB.2.raw
  modified_base (264)..(264): a, c, t, g, unknown or other
  modified_base (289)..(289): a, c, t, g, unknown or other
  modified_base (377)..(377): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacagtccaccctctcctgcagggccagtacaaaatataacaactacttagctgtaccaanagaacctgccaggctccagctcctnatctatgatgctagtttaggaggggccactcggcactccccaccgagggtttcaggtggcaggtgggtctgggacagtcttcattccncaacactccgcacgacctagacgtcctagtaagtattttaggacttagttttaacttacgttcgtacaacgagtacgtagactaggcgaacggcccgttaccggaccggtaccggttccggaccgaaacggggaaccgtaagggtagggtaaacggtcgaaaggtcgaaacgttgggtcggcgttacggacaaccgttcttaccgttcgttcctttaactaccgttcccttaccccgtcttaacgtttccg

SEQ ID NO: 441317 - DNA, 671 bp, Homo sapiens
  misc_feature: GZ8MTXP01EJW75.11.57.F02.1.454.CMB.2.raw
  modified_base (204)..(204): a, c, t, g, unknown or other
  modified_base (264)..(264): a, c, t, g, unknown or other
  modified_base (273)..(273): a, c, t, g, unknown or other
  modified_base (280)..(280): a, c, t, g, unknown or other
  modified_base (284)..(284): a, c, t, g, unknown or other
  modified_base (287)..(287): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaaatattaaacaactacttagcctgtaccaanaacgaaccnggcacgngccngcnctcatctatgatagtacgaagttacggacggccgacctagtccacctacccgtacccaaggttcgacgtggtcggtactgggtccgtaggtacgtacgagttacctactactctaccacctacgtccgtacgacgaccgtagacgtacgttagtaacgttagtttagttacttaagtttacttaacgtacgtacgtaacgtacgtacgtacgacgggacgtaccggtaccggtacccggtcccggtaccggtaaccgggtaccggaaccgggtaacgggtaaacggtaacggtaacggtaacggtaacgtaacggacggtacgttcggtcggtacgttacgttccttacgtcttctcttccttccttaccttccgttcccgtcg

SEQ ID NO: 441318 - DNA, 534 bp, Homo sapiens
  misc_feature: GZ8MTXP01A3BDK.11.57.F02.1.454.CMB.2.raw
  modified_base (204)..(204): a, c, t, g, unknown or other
  modified_base (262)..(262): a, c, t, g, unknown or other
  modified_base (284)..(284): a, c, t, g, unknown or other
  modified_base (507)..(507): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaanagaaacctgccaggctccagcnctcatctatgatgcatttaggaggccagtggcatcccaccaggttcagtgcagtggtctgggacagacttcattctcaaccatcccgcacgcctagacgcctgaagtatttgctagtttattactgtacaacagcgtagcagcgacggccctccggcgtacgttccggccgaagggacccaagggtaggaagtccaaaggcgaacgttggtggcgtggcacgnttctgtctcactcttcccgcttaatcg

SEQ ID NO: 441319 - DNA, 730 bp, Homo sapiens
  misc_feature: GZ8MTXP01AFREY.11.57.F02.1.454.CMB.2.raw
  modified_base (205)..(205): a, c, t, g, unknown or other
  modified_base (262)..(262): a, c, t, g, unknown or other
  modified_base (291)..(291): a, c, t, g, unknown or other
  modified_base (406)..(406): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatataacaactactagcctggtccaanagaacctggccaggcctcccaggctcccncatctatgatgactagtttagggacggccacgtcggcactccccaccgtaggtttcaggttggcgtaggtcgggtcgtacgggacagtaccttcagttcccacaacctctcccgntaccgccgtagacgtccctaggaacgttactttcgacgtttaagttttacttaccgtaggttaccaaacgtaggtccgttaagccgaaggtccggggaacggggtccccggttaccgggaccgggttaacccgggttaccgggaacccgggtaaacgggggtaaacccggaagggggttaaccgggaaacggttaacccggaaacgggtaaccgtaaaccgggttgggttaccggggcctaccgggacccttaccggttacttcccgttcggtttcttaacccgttacgttccccgttccccggtaacttaacgtttaacccgg

SEQ ID NO: 441320 - DNA, 607 bp, Homo sapiens
  misc_feature: GZ8MTXP01BGYVR.11.57.F02.1.454.CMB.2.raw
  modified_base (567)..(567): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatataacaactacttagcctgtaccaacagaacctggccaggctccagctctcatctatgatgctagtttaggaggccagtggccaactccccaccgtaggtttcaggtcggcaggtgggtctcggggacagtactctacttctccaaccatcccgcacgcctagacgtaccgtgaagtatttgacgttagtttattacgtacgttacaacgagacgtagacacggtcgacggtcccgtaccgggaccggtaccggttccgggaccgaaacgggtaacccgaagggtacggaacgtacgaaggaacgtacgttagggtcgcgtcgacaccgttnttcgttgtaccttcacttccgttacccgtcttaacgttcg

SEQ ID NO: 441321 - DNA, 689 bp, Homo sapiens
  misc_feature: GZ8MTXP01CN084.11.57.F02.1.454.CMB.2.raw
  modified_base (204)..(204): a, c, t, g, unknown or other
  modified_base (265)..(265): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaaatattaacaactacttagcctggttaccaanagaaacctggccaggctcccaggctcctcatctatgatgctagtttagggacgggccacgtggaccacgtcccccaacccgtagggtttcaaggttcggccgtagggttcgggggttcgtacgggggactaggtacctttctaactttccctaccaaccctacgtcccggcacggccctaggacgtacctagaagttattttgacttaagttttattacgttacgtacaacgagtacgtagacacggacgacgggtcccgttccgggacgtaacggttccggaccgtaaagggacccgtaagggtacggaaacgtacgaaggtaacgaaacggttgggtacggcgttacggaccttaccgttgttaccgttcggttacccgttaactaacctttcccgtttaccccgaaccgttaacgttcccg

SEQ ID NO: 441322 - DNA, 531 bp, Homo sapiens
  misc_feature: GZ8MTXP01AYUZ0.11.57.F02.1.454.CMB.2.raw
  modified_base (303)..(303): a, c, t, g, unknown or other
  modified_base (365)..(365): a, c, t, g, unknown or other
  modified_base (382)..(382): a, c, t, g, unknown or other
  modified_base (405)..(405): a, c, t, g, unknown or other
  modified_base (411)..(411): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggtttcctgttgctatttagaggtgtccagtgcgaggtgcaagtggtgcagtctgggggaggcttaggtccgaggccgggggggtccctgagactctcctgtctagtctctggattcgcctcagtgactatgccatgaagtgggtccnccaggctccgaggtaaggggctgggaatggatttcatacattacgcagtagtggtgcgaccntatactacgcagactcngtagaagggccattcatcatccncagganactaatgacaacgtaactcactgtaatccgtaggaaactacaactacgacctcgagaagcggaggacgacggcgtgttagttattattgtgcgagacgccccgtaaccggttcgaaccgg

SEQ ID NO: 441323 - DNA, 618 bp, Homo sapiens
  misc_feature: GZ8MTXP01C0WOE.11.57.F02.1.454.CMB.2.raw
  modified_base (204)..(204): a, c, t, g, unknown or other
  modified_base (257)..(257): a, c, t, g, unknown or other
  modified_base (277)..(277): a, c, t, g, unknown or other
  modified_base (280)..(280): a, c, t, g, unknown or other
  modified_base (302)..(302): a, c, t, g, unknown or other
  modified_base (381)..(381): a, c, t, g, unknown or other
  modified_base (586)..(586): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacggagaaattgtgttgacacagtctccggccaccctgtctgcgtctccgtggggaaacngtcacctctctgcaggccagtacaaaatataacaatactagcctggtaccaanagaacctgcaggctccagcnctnatctatgatgatagtttagggnggtccacgtgcactcccaccgtagttcagtggctaggtggtcgtgggacagtacttcatttacctcaacctatcccganacgaccctagacgtccgtagtaagttactttaggacttaaggttttactaacgttcggtaactaaacgaggtacgttagaccgtacgacggaaccggggtccccgtaccggggacgtaaccggttccgggaaaccggtaaggggacccgtaaagggggtccgaaagttccgaaagcggtaaacgttgggtacgctcggcacgttnttcgtaagtcttcgcttccttccgcttaatcg

SEQ ID NO: 441324 - DNA, 548 bp, Homo sapiens
  misc_feature: GZ8MTXP01APHIE.11.57.F02.1.454.CMB.2.raw
  modified_base (263)..(263): a, c, t, g, unknown or other
  modified_base (286)..(286): a, c, t, g, unknown or other
  modified_base (361)..(361): a, c, t, g, unknown or other
  modified_base (363)..(363): a, c, t, g, unknown or other
  modified_base (374)..(374): a, c, t, g, unknown or other
  modified_base (385)..(385): a, c, t, g, unknown or other
  modified_base (526)..(526): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctccagataccaccggagaaattgtgttgacacagtctccggccaccctgtctgcgtctcctggggaaacagtcaccctctcctgcagggccagtcaaaaatattaaacaactacttagcctggttccaanagaaacctggcaggctccaggcnctcatctatgatgcatttaggaggcatgcatccacccagttcagtggcagtgggtctgggacagtacttcattcncnccaatcccganacgctaagacncctagaagtatttcgactagtttaagtttaacttagtacaacaacgacgtagacacgacggacggccgtccggcgacgtcggtaccgaacggaacgaacggtaggaagtacgaagaagaacgagtgcgtgcacgacttctntcttctctcttcctccttctcg

SEQ ID NO: 441325 - DNA, 692 bp, Homo sapiens
  misc_feature: GZ8MTXP01DJ8OG.11.57.F02.1.454.CMB.2.raw
  modified_base (205)..(205): a, c, t, g, unknown or other
  modified_base (264)..(264): a, c, t, g, unknown or other
  modified_base (286)..(286): a, c, t, g, unknown or other
  modified_base (288)..(288): a, c, t, g, unknown or other
  modified_base (397)..(397): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcagggccagtacaaaatattaacaactacttagcctggtaccaanagaacctgccaggctccaggcncncatctatgatgctagtttagggacgggcctacgtgggctactccccacccgtaggtttcaggtggacaggtgggtctgggacagtacttcattccacaaccatcccganacggccctagacgcctagaagtactttcgacttagttttatacttacgtacaacgaggacgtaagcaacggacgacgggtcccgtacccggggacgtaccgggttacccgggacccggaaacggggtaaacccgtaaagggggttacgggaaacggtacgaaacggggtaaccggtaaacgttggggtaaccgggccgttacgggcccgttaaaccccttagtttaccccgttcggtttaccttttcccgtaaccctttccccgtttaccccggtccccttaaacggtttcccgg

SEQ ID NO: 441326 - DNA, 748 bp, Homo sapiens
  misc_feature: GZ8MTXP01EI4AC.11.57.F02.1.454.CMB.2.raw
  modified_base (286)..(286): a, c, t, g, unknown or other
  modified_base (293)..(293): a, c, t, g, unknown or other
tcagcgagagataccacgaccggtgctcgatttagctcgatatagttggggtttgggggaggaactgctcagttaggacccagagggaaccatggaagccccagctaagcttctcttcctcctgctacactggctcccagataccaccggagaaattgtgttgacacagtcctccggccaccctgtctgcgtctccgtaggggaaacagtccaccctctcctgcagggccagtacaaatataacaactactagcctgtaccaacagaacctgcaggctccagctcncatctangatgctagttaggacggcctacgtggaccactaccccacccgtaggtttaccaggtcggcgtaggtggggtccgtggggtacccaggtacttctactttaccctaacccaccctaacgtcccgacaacgacccgtaagacgtaccgttagtaagttattttacggacttacgttttaacttacgttacttacgtaaacgtacgtacgttaacgaccgaggacccgtaacggggggtccccgttaccccggggtaccggtacccgggttacccggggacccgaaaaccgggggtaccggaaaaacggggttcggggtaaacgtaccggaacgggtaacccgtaaaggttcggttacggggaccttacggaccgtaacccgttagttcccggttagtttccctttaccgtaacctttcccccggttacccccgttaccgttaacgttaaccgtaacg

SEQ ID NO: 441327 - DNA, 591 bp, Homo sapiens
  misc_feature: GZ8MTXP01AGCLG.11.57.F02.1.454.CMB.2.raw
  modified_base (204)..(204): a, c, t, g, unknown or other
  modified_base (256)..(256): a, c, t, g, unknown or other
  modified_base (258)..(258): a, c, t, g, unknown or other
  modified_base (275)..(275): a, c, t, g, unknown or other
  modified_base (278)..(278): a, c, t, g, unknown or other
  modified_base (352)..(352): a, c, t, g, unknown or other
  modified_base (364)..(364): a, c, t, g, unknown or other
  modified_base (373)..(373): a, c, t, g, unknown or other
  modified_base (404)..(404): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatataacaactactagctgtcaananaacctgcagctccagcnctnatctatgatgctatttaggaggcattgcatcccaccagttcagtgcagtggtctagggacagtatttcatttcncaaccatcccgnacgcctagngcctagaatatttgactagtttataacgttntacaacgagtacgtagacgacgcggacggtcccgtaccggaccggtaaccggtaccggaaccggaaacggggtaaccgtaaagggtacggtaaacgtacgaaacggaacgtaacgttggtacgcgtacgaccttaaccgttattccgtcgttcttaacgtaccttcccgttacccgtccttaagtcg

SEQ ID NO: 441328 - DNA, 655 bp, Homo sapiens
  misc_feature: GZ8MTXP01CTU5D.11.57.F02.1.454.CMB.2.raw
  modified_base (209)..(209): a, c, t, g, unknown or other
  modified_base (272)..(272): a, c, t, g, unknown or other
  modified_base (296)..(296): a, c, t, g, unknown or other
  modified_base (298)..(298): a, c, t, g, unknown or other
  modified_base (485)..(485): a, c, t, g, unknown or other
  modified_base (493)..(493): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaaccggagaaattgtgttgacacagtctccggccaccctgtctgcgtctccgtaggggaaaacngtccaccctctcctgcgagggccaagtaacaaaaatattaaacaacttatagcctagtacaanaagaaacctggcagcctccgagcncncatctatgatgactagtttagggacggaccaagtcggacacgttaccccaccgtagggtttccaggtggctaggtgggtcctaggggacagtactttcaattccacaacctactcccgactacgtaccgagggactacctagtaagttattttggacttaaagttttactaagttcgaactaaacgngtacgtanaccgagacgtaacgggcccgttacgggcgtaaccgggttccggacccgaaaggggaacccgtaaagggtacggaagtaccaaaggtccgtaaattgggtacggttcctacgaccttacgttcttcgttcttaccttcttacctcccgttaccctcgttgtcg

SEQ ID NO: 441329 - DNA, 635 bp, Homo sapiens
  misc_feature: GZ8MTXP01DMTXJ.11.57.F02.1.454.CMB.2.raw
  modified_base (266)..(266): a, c, t, g, unknown or other
  modified_base (292)..(292): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctccagataccaccggagaaattgtgttgacacagtctccggccaccctgtctgcgtctccgtaggggaaacagtccaccctctcctgcagggccagtacaaaatattaaacaactactagcctggtaccaanagaacctgcaggctcccaggctcctnatctatgatgctagtttaggacggaccacgtggacactccccaccgtaggtttcaggtggcgtaggtggggtcgtaggggacagtacttcactttcctaccaaccctactcccgacacgtacccgtaagacgtcccttagaaagttatttgacttagtttacttactgtacaacgagacgtacgcgacgcggacggccgtaccggcggtaccggttcggaccggaaacgggaaccgaaagggtacgggtaaagtaccgaaaggtaaccgtaagttcggtcggcgtacggccaacttcttacgttcggttcttctacttcccgttccctccgttaacttaaccg

SEQ ID NO: 441330 - DNA, 761 bp, Homo sapiens
  misc_feature: GZ8MTXP01EX0OK.11.57.F02.1.454.CMB.2.raw
  modified_base (286)..(286): a, c, t, g, unknown or other
tcagcgagagataccacgaccggtgctcgatttagctcgatatagtttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctgttccaacagaaacctgcaggctcccaggcncctcatctatgatgactagtttagggacggtccacgtggcaactccccgaccctagggtttccaagggttcggactagggttcggggtcttacgggggacctagtactttcgaacttttccgaccaacctatcccggacaacgtcccttaaggacgtacccgttaggtaaagtttagtttttacggactttaaggtttttaactttaaccgttcgggttaaccaaacgtaacggtaccggtaaggtaccgtaaggttaccgggggccccgtttacccggggaccggtaacccgggtttacggggaaccccgtaaacgggggtaacccgaaacgggggttagggtaaacgttacccggaaaacgggccggtaaaccgttgggttcgggccgttacgggtacccaaccttaacgttcttcggttaaccctttcgtaaccttccccgtttaccccgaccctaagttcccgtttaacgg

SEQ ID NO: 441331 - DNA, 557 bp, Homo sapiens
  misc_feature: GZ8MTXP01A51R3.11.57.F02.1.454.CMB.2.raw
  modified_base (373)..(373): a, c, t, g, unknown or other
  modified_base (375)..(375): a, c, t, g, unknown or other
  modified_base (432)..(432): a, c, t, g, unknown or other
  modified_base (526)..(526): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctccaggctcctcatctatgatgctagtttaggagggccagtggcatccccaccgaggttcagtggcaggtgggtctggggacagacttcattcncnccatcccgcacgcctagacgcctagaagtattttgcttagtttattactgtacaacngacgtagcaggcgacggccgtccggcgtacggttcggaccgaagggaccgaaggtggaaagtcgaaaggcgtaacgttggtacggctcgcacgnttctgttcttctactccttcccgcttcttcg

SEQ ID NO: 441332 - DNA, 663 bp, Homo sapiens
  misc_feature: GZ8MTXP01BI8WP.11.57.F02.1.454.CMB.2.raw
  modified_base (204)..(204): a, c, t, g, unknown or other
  modified_base (257)..(257): a, c, t, g, unknown or other
  modified_base (279)..(279): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtacaaaatattaacaactactagctgtcaanagaacctgcaggctccagctcncatctatgatgcagtttaggaggccagtcggcactccccaccgtaggttcaggtggctaggtgggtcgtcgggactagacttcattcctacaacctagtcccgacacgtccctaagacgccctagtaacgttaattttgacgtacgttttaacttacgtacgtttacaaaccgtagcgttaagacacggccgaacgggtcccgtccgggaccggtacggttcccgggaccgaaacggggaacccgtaaagggtacgggtaaacgtaccgaaacggccggtaaacgttcgggttaacgggccgttagaacccgttaaccgttacgttccggtttaagtcccgtttaacgtaccttccctttccccgtaacccgttaacgtttccg

SEQ ID NO: 441333 - DNA, 546 bp, Homo sapiens
  misc_feature: GZ8MTXP01BEPC0.11.57.F02.1.454.CMB.2.raw
  modified_base (366)..(366): a, c, t, g, unknown or other
  modified_base (415)..(415): a, c, t, g, unknown or other
  modified_base (490)..(490): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggccggggggtccctgagactctcctgtctagtctctggattcgcctcagtgactatgccatgagtggtccgcaggctcgagggtagggctgggaatggtatttcatacattacgctagtagtggtgaccgacntatactacgcagactcgtgtagaagggccgattcatcacgtctaccganagacaagtcgacaaacgactcactgtatctagaaatcaactgcctgagaagtcgaggacacggtctagttagttntttagttaaggcggtaacgtacggcccgttacccccgtaagggttcgtaacccggg

SEQ ID NO: 441334 - DNA, 694 bp, Homo sapiens
  misc_feature: GZ8MTXP01DLD1M.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgcttattttagaaggtgtccagtgcgaggtgcagtggtgcagtcgtgggggagtcttacgccgagggccggggggtcctgacgactctcctgtctagtctcgtggattcgcctcagtcgactatgccagtgaaggtcgggtcccgccgaggcctaccgagggggtaaacgggggctagggtaaatgggtacttttcgaatacgtatttacgcaggtagtggtgaccgacctaagtaactacgtacgcagactcgtgtggaagggccgtatcatacacttctacgagagaacaataggaccaaacgtaacctctaacttacggtaacttaccgtaaggtaaaacttaccgaaactacggtaccccgtaggaaacgggtaacgttccggggaaacgggtaaccggacccgggttacgtttagggtttaaaactttaacggtttttacgtttaagggttaccggaaccgggttaacgggaaccccggttacccccccggtttaacggggttcgggttaaaccccggggg

SEQ ID NO: 441335 - DNA, 620 bp, Homo sapiens
  misc_feature: GZ8MTXP01A5WGQ.11.57.F02.1.454.CMB.2.raw
  modified_base (204)..(204): a, c, t, g, unknown or other
  modified_base (373)..(373): a, c, t, g, unknown or other
  modified_base (451)..(451): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaaatataaacaactacttagcctggtaccaacagaacctggcaggctcccagctctcatctatgatgcagtttaggagggccactggcaatccccacctaggttcaggtggcaggtcggtctgggacagcttcattccacncactccgacacgtcccgtaagcgtcctagacgttatttgactagtttacttacgtgttaacaacgtagacgtacgacncggacgacggtcccgttaccggaccggtacggttccggaccgaaggggtaaacccgaagggtacggtaaacggtacaaaggtaaccgaacgttggtcggacttacggccaaacttcgttccttggttacccttaacgtacttccccgttaccgtaaccttaacgttccg

SEQ ID NO: 441336 - DNA, 565 bp, Homo sapiens
  misc_feature: GZ8MTXP01CFQWM.11.57.F02.1.454.CMB.2.raw
  modified_base (203)..(203): a, c, t, g, unknown or other
  modified_base (263)..(263): a, c, t, g, unknown or other
  modified_base (287)..(287): a, c, t, g, unknown or other
  modified_base (290)..(290): a, c, t, g, unknown or other
  modified_base (373)..(373): a, c, t, g, unknown or other
  modified_base (387)..(387): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtacaaaatattaaacaactacttagcctaggttccaanagaacctggccaggctcccaggcnctnatcatgatgcatttaggaggccacgtggcatccccgaccaggtttcagtggcgagtgggtctcgggactagtacttcatttcncaaccagtcccganacgcctagactccagtatatttgctagtttatactgtacaacgtgactagcagcgacggtccgtccggacgtacgtcgacgaacggaccgaaggtcgaaagtcaaagcgaacgttggtacggcttacgcttacgttcttcttaacgtactccgttactccgttcccgtcttaattccg

SEQ ID NO: 441337 - DNA, 561 bp, Homo sapiens
  misc_feature: GZ8MTXP01E3RXE.11.57.F02.1.454.CMB.2.raw
  modified_base (287)..(287): a, c, t, g, unknown or other
  modified_base (381)..(381): a, c, t, g, unknown or other
  modified_base (393)..(393): a, c, t, g, unknown or other
  modified_base (404)..(404): a, c, t, g, unknown or other
  modified_base (413)..(413): a, c, t, g, unknown or other
  modified_base (553)..(553): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaaacaactacttagcctggttccaaacagaaacctgccaggctccaggcncctcatctatgatgctagtttagggagggccaacgtggctatccccacccaggtttcagtggcaggtgggtctggggacagtacttcattaccncaaccatcccgnagcctaggacnctagaagtntttgcttagtttattactgtacaaagagcgtagcagcgacggtccgtcggcgtaaccgtcgacgaacgggaccgaagggtagaagtcaagtaacgaacgttggtggcgtgacacgcgttctgtcttctactccgttcccncgttaatc

SEQ ID NO: 441338 - DNA, 591 bp, Homo sapiens
  misc_feature: GZ8MTXP01DAX6P.11.57.F02.1.454.CMB.2.raw
  modified_base (205)..(205): a, c, t, g, unknown or other
  modified_base (262)..(262): a, c, t, g, unknown or other
  modified_base (284)..(284): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacggagaaattgtgttgacacagtctccggccaccctgtctgcgtctccgtaggggaaacngtccaccctctcctgcaggccagtacaaaatattaacaactacttagcctgtacaanagaacctgcagctccagctctnatctatgatgactagtttaggaggccacgtggactactaccccaccgtaggtttcaggttggcgaggtgggtcgtcggggacagtactttctacttcctaccaacctactcccgacacgtaccctaaggacgtcctagtaagttattttagacttagttttaacttacttagtacaacgagtacgtagcacgcggacggccgtcggcgtacggtcggacgaacggacgaaggtgaagtacgaagaacgaacgttggtcgcgtacgcaacgcttacttgtcttctacttccttacccgtcaacgttcg

SEQ ID NO: 441339 - DNA, 563 bp, Homo sapiens
  misc_feature: GZ8MTXP01CVNL1.11.57.F02.1.454.CMB.2.raw
  modified_base (314)..(314): a, c, t, g, unknown or other
  modified_base (487)..(487): a, c, t, g, unknown or other
  modified_base (525)..(525): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcaggtcgtgggggagtcgttaggtccgacgggcccggggggtccctgacgactctcctgtctagtctctggattcgcctcagtgactatgccatgaagtggtccncaggcctcgaaggtagggctgggaaatggtatttcgaatacatttacgctaggtagtggtgaccgaaccaagtactactacgcagactctagtagaaggccgtattcattcaatcctaccagagacaagtacgacaaactaactctaactagtactcgtaggaaactacaacngaccgtagagaagtcgaaggaccacggtctgttaattnttagttgacgcgacgccgcccctaagggcgtaacccgg

SEQ ID NO: 441340 - DNA, 586 bp, Homo sapiens
  misc_feature: GZ8MTXP01AIVPH.11.57.F02.1.454.CMB.2.raw
  modified_base (277)..(277): a, c, t, g, unknown or other
  modified_base (279)..(279): a, c, t, g, unknown or other
  modified_base (286)..(286): a, c, t, g, unknown or other
  modified_base (324)..(324): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacagtcaccctctcctgcagggccagtacaaatataacactactagcctgtcaacagaacctgcaggctccagcncncatctangatgctagtttaggagggccacgtggcactccccaccnggttcagtggcaggtgggtctcgggacagtacttcattcctcaaccatcccgacacgcctagcgccctgtaacgtattttgacttagtttacttacgtgtacaactgcgtaagcagcgggacggcccgtccgggaccggtaccggttcggacccgaaggggacccaagggtggaaacgtcgaaaggcgtaacgttgggacggctcggaccaccgacttcgttcggtcctttcgacttcccgtttaccccgcgttaacttccg

SEQ ID NO: 441341 - DNA, 592 bp, Homo sapiens
  misc_feature: GZ8MTXP01ATJBG.11.57.F02.1.454.CMB.2.raw
  modified_base (415)..(415): a, c, t, g, unknown or other
  modified_base (458)..(458): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcttagtccgaggccggggggtccctgacgactctcctgtctagtctctggattcgcatcagtgactatcgccagtggaaggtcggggtcccgaccgaggcctaccggaagggggtaagggggctagggtaagttggtactttacattacgattaggcgtaggtagtggtacgcgaacctatactactaccgnacgtactcgtgtaggaacgggtccgtatcatacactcacaganacagtgacaacactacacgtgtactacgtagaaactacaactagcctaggaacgtagttacgggaacggacgtacgggtcttagttagttattaagtaggtcgacgtacggacccgtccccgttcggtaaccgg

SEQ ID NO: 441342 - DNA, 838 bp, Homo sapiens
  misc_feature: GZ8MTXP01B3HQV.11.57.F02.1.454.CMB.2.raw
  modified_base (205)..(205): a, c, t, g, unknown or other
  modified_base (263)..(263): a, c, t, g, unknown or other
  modified_base (281)..(281): a, c, t, g, unknown or other
  modified_base (284)..(284): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtcaccctctcctgcaggccagtacaaaatattaaacaactacttagcctgtaccaanagaactgcagctccagcnctnatctatgatgctagtttagggacggccacgtcggccaacgtccccacccgtaggtttcagggtcggactagggtcggggtccgtacggggacctaggtacctttccgattttccctaaccaacccctacgtccccggacctaacggtcccgttaaacggacgtacccgttaaggtaaacggtttattttttacggtaacgtttaaacgttttttaacgtttaaccgtttaggttaaccctaaacggtaacggtacccggttaacggaccgtaacgggtcccggttaaacccgggggtccccggttaccccgggggtaaccccgggtaacccgggtttaccccgggggaaaccccgggaaaacgggggtaaaccccggtaaagggggttaaccggggtaaaacgggttaccgaaaaccggggtaaccgggtaaaccggttggggttaccggacgttcccgggaaccttaacccgttacgttccgtttaaccggttacccgtttaacctacccggtttcccctttacccccgggttaaccttaacggttttcccgg

SEQ ID NO: 441343 - DNA, 557 bp, Homo sapiens
  misc_feature: GZ8MTXP01AUYLR.11.57.F02.1.454.CMB.2.raw
  modified_base (203)..(203): a, c, t, g, unknown or other
  modified_base (524)..(524): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtacaaaatattaaacaacttacttagcctggttaccaacagaaacctggccaggcctccaggctcctcatctatgatgcagtttaggagggccacgtggccactccccacccgaggtttcagtggctaggtgggtctgggacagtacttcattctcaaccatccgcacgctagctcctagagtatttgcttagtttattactgtacaacgagtcgtagcaagcgacggccgtcggacgtcgttcggacgaagggaccaaggtggaagtcgaagccgaagttggtaggcgtcgcacgttnttcgtgtcttcgactccgttcccgtcttcgtcg

SEQ ID NO: 441344 - DNA, 640 bp, Homo sapiens
  misc_feature: GZ8MTXP01A1JQK.11.57.F02.1.454.CMB.2.raw
  modified_base (205)..(205): a, c, t, g, unknown or other
  modified_base (257)..(257): a, c, t, g, unknown or other
  modified_base (275)..(275): a, c, t, g, unknown or other
  modified_base (278)..(278): a, c, t, g, unknown or other
  modified_base (284)..(284): a, c, t, g, unknown or other
  modified_base (363)..(363): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcaggccagtacaaaatataacaactactagctgtcaanagaactgcagctccagcnctnatctangatgctagtttaggacggcacgtgcactcccaccgtagtcaggtggcaggtgggtcgtcggggactagtacttcattcnccaacactccgactacgcctaagcgtcctagtaagttcgttttagacgttaagttttacttacgttacggttaacaacgtacggtacgtaagaccgaagccgggaacgggtccccggttaccgggaccggttaaccggttacccgggaaccggaaacggggtaacccgtaaacggggtacggtaaacggtacgaaacggaacgtaaccggttggcggttacgtacggtaccacttcgttccgtgtacttctactcccgttaccctccttaacgttcg

SEQ ID NO: 441345 - DNA, 656 bp, Homo sapiens
  misc_feature: GZ8MTXP01BCQ6E.11.57.F02.1.454.CMB.2.raw
  modified_base (204)..(204): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactacttagcctaggtaccaacagaacctggccaggctcccagctcctcatctatgatgctagtttaggaggccagtggccactccccaccgtaggttcaggtggctaggttggggtcctaggggactaggtaccttcgactttccacccaacctactccccggacaccggtacccttaggaccgtacccgtagtaagttacgttttagactttaacggttttaatttaccgttattacaaacgtagacgttagacgacgacgacggtcccgtccgggaccgtacggtccggaccgaagggacccgaagggtaggaacgtacgaacggcgtaaacgttgggtacgcgtccgacgttaacccgttgttaccgtcgttccttccgtacttcccgttacccgtccttaacgttcg

SEQ ID NO: 441346 - DNA, 625 bp, Homo sapiens
  misc_feature: GZ8MTXP01AXN3V.11.57.F02.1.454.CMB.2.raw
  modified_base (260)..(260): a, c, t, g, unknown or other
  modified_base (281)..(281): a, c, t, g, unknown or other
  modified_base (283)..(283): a, c, t, g, unknown or other
  modified_base (373)..(373): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatataacaactacttagcctgtccaanagaaacctgcaggctccagcncnatctatgatgctagtttaggagggccacgtggcactccccacctaggttcaggtggcaggtgggtctggggacagtacttcatttcctcnccatcccgcacgcctagacgtcctagtaagtatttgacttagtttattactgttacaaacgagtcgtagcacgcgacgggtcccgtccgggacgtaccggttccggaccgaaacggggtaaccgaaggggtacgggaacgtacggaaggtaaccggtaaacgttcggtacggcgttacggaccaaccgttacttccgttaacggtttctttaaccgtaactttcccgtttaccccggccttaacgtttcccg

SEQ ID NO: 441347 - DNA, 738 bp, Homo sapiens
  misc_feature: GZ8MTXP01BDZD9.11.57.F02.1.454.CMB.2.raw
  modified_base (205)..(205): a, c, t, g, unknown or other
  modified_base (258)..(258): a, c, t, g, unknown or other
  modified_base (277)..(277): a, c, t, g, unknown or other
  modified_base (279)..(279): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtaggggaaacngtccaccctctcctgcaggccagtacaaaatataacaactactagctgtcaanagaactgcaggctccagcncnatctatgatgactagtttaggacgggcctacgtcggacctaaccgtcccccaaccgtacgggtttcgaacggtcggacgtaagggttcggggtccgttacggggaacctacggtacctttctaacttccctaacccgaacctacgtccccgacaccgtaccgtaggacgtacctagtaagttattttcgacttaagtttacttacgtaggttaacaaacgtacggtacgtagacgacgtaccggggacggtacccggttacccgggacggttaaccggttcccggggaaaccggaaacgggggtaaacccgtaaaggggtaacggaaacggttaccgaaagggaaccggtaaacggttcgggtacggttcgtaaccggacccgttaacgttcgtttccgttaaccggtcctttaaccgtaaccgtttccccgtttacccggaacctttaacgttaacgg

SEQ ID NO: 441348 - DNA, 620 bp, Homo sapiens
  misc_feature: GZ8MTXP01BP4JH.11.57.F02.1.454.CMB.2.raw
  modified_base (206)..(206): a, c, t, g, unknown or other
  modified_base (238)..(238): a, c, t, g, unknown or other
  modified_base (295)..(295): a, c, t, g, unknown or other
  modified_base (302)..(302): a, c, t, g, unknown or other
  modified_base (388)..(388): a, c, t, g, unknown or other
tcagcgagagataccacgaccggtgctcgatttagctcgatatagttggggtttgggggaggaactgctcagttaggacccagagggaaccatggaagccccagctaagcttctcttcctcctgctacactggctcccagataccaccggagaaattgtgttgacacagtctccggccaccctgtctgcgtctccgtggggaaacngtcaccctctcctgcagggccagtacaaaatnttaaacaactacttagcctggttaccaacagaaacctggccaggctcccaggctccncatctangatgctatttaggaggccactggcactccccaccctaggtccaggtgcaggtgggctgggaccaggacttcattccgtaacacctntcccgcacgccctaagacgccgtagaacgtattttcggcttagtttaattacgtagttacaaacgtagccgtaagcaagccgaacgggggtcccttaccggggccgtacgggttccggaccgaacggggtaccgaaacgggtaggaacgtacgaaacggcgaaaccgtggttaggccttcggcacccttagttcttacgtcttacaacttccttcccgcctaattcgtaacg

SEQ ID NO: 441349 - DNA, 645 bp, Homo sapiens
  misc_feature: GZ8MTXP01D4ENC.11.57.F02.1.454.CMB.2.raw
  modified_base (204)..(204): a, c, t, g, unknown or other
  modified_base (290)..(290): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcacctctcctgcagggccagtacaaaatattaacaactacttagcctggttaccaacagaaacctgccaggctccaggctcctnatctatgatgctagtttaggacggccacgtggacactccccgaacccgtaggtttcgaacggttggaccgtaggttcggggtccgtcgggggaacctaggtacctttctaatttccctacaacccgatacccgcacgccctaagacgtcctagtaagttatttcgacttaagtttattactgttacaacgagtacgtagactagccggaacggccgtaccggacggtaccggttccgggaccgaaacggggtaacccgaaagggtaggtaaacgtcgaaggaacgtaaacgttggtacgcgtacggacaccgttattcgtgttcttcgtacgttccttccccgtcttaagttccg

SEQ ID NO: 441350 - DNA, 729 bp, Homo sapiens
  misc_feature: GZ8MTXP01AFQ1K.11.57.F02.1.454.CMB.2.raw
  modified_base (203)..(203): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctccagataccaccggagaaattgtgttgacacagtctccggccaccctgtctgcgtctccgtggggaaacngtccaccctctcctgcagggccagtacaaaatattaaacaactacttagcctggttaccaacaagaaacctggaccacggcctcccgaggctcctacatctatgatgtactagtttagggacgggtccacgtggcactccccaccgtaggtttcaggtggcgtaggtcgggtacgtcggggactaggtacttcgattccacaacctactccgactacgacctagcgtaccgtagtaagttattttcgacgttaagttttattaaccgtgtaacctaaacgtcgggtaaccgttaacggacctaaccgggtccggggtaacccggggtcccccggttaccgggggaccccggtttaacccgggttcccgggggaaaccggaaacgggggtaaacccgtaagggggtaacgggtaaaccgtacggaacgggtaaccggtaaacgttcgggacggttcgttacggaacccttacgttatttccgtaacgtttctaacgttaccgtcccgttaccctcttaacgtttccg

SEQ ID NO: 441351 - DNA, 576 bp, Homo sapiens
  misc_feature: GZ8MTXP01AFRC3.11.57.F02.1.454.CMB.2.raw
  modified_base (304)..(304): a, c, t, g, unknown or other
  modified_base (357)..(357): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtcctgagactctcctgtctagtctctggattcgcctcagtgactatgccatgaagtgggtccncaggctcgagggtacgggctgggaatggatttcatacattacgcagtagtggnaacgacaatatactacgcagtactcgtgtaggaacggccgattcgattcaactctaccgagaagacaaatcgacaaacaactcactagtaatcgtaagaaactcaacgacgacctaggaagaaggtcggacggtaacgaccggtacgttaagttacttagttaagtttggtcggaacggtacggacccggttaccccccgttaagggccgtaacccggg

SEQ ID NO: 441352 - DNA, 548 bp, Homo sapiens
  misc_feature: GZ8MTXP01D8KWK.11.57.F02.1.454.CMB.2.raw
  modified_base (504)..(504): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcttagtccgaggccggggggtcctgagactctcctgtctagtctctggatcgcctcagtgactatgccagtgaaggtgggtcccgccaggcctccgaaggggtaacgggctagggatggtatttcatacagttacgctagtagtgtgaccgacaatatactacgctagactcgtagtggaagggcctatcatcatctacaagagaacatagacaacaactcatcgtaatctaaggaaactacaaacgagtcctaggacgaagtcggaaggacgaacggttntagttattattagtgcgcgacgccgttacccgtaaggcgtaacg

SEQ ID NO: 441353 - DNA, 547 bp, Homo sapiens
  misc_feature: GZ8MTXP01BU1D1.11.57.F02.1.454.CMB.2.raw
  modified_base (239)..(239): a, c, t, g, unknown or other
  modified_base (295)..(295): a, c, t, g, unknown or other
  modified_base (348)..(348): a, c, t, g, unknown or other
  modified_base (386)..(386): a, c, t, g, unknown or other
  modified_base (397)..(397): a, c, t, g, unknown or other
  modified_base (401)..(401): a, c, t, g, unknown or other
  modified_base (477)..(477): a, c, t, g, unknown or other
  modified_base (510)..(510): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgctcctccgngctttgcttgctattatgcacctccacgccgtccacgtaccagtgaacttgacctnagggtcttcgtgctcacgtccaccaccacgcatgtcgacctcgacggggtccncaggctccccgaggtaagggctggatggatttcatacnttagcagtagnggtncgtacatatactacgcagactctgtgaaacgggcaattcaatcaatccgtaccagagacaaactggaccaaacacncaacttgaactcgttaggaaactcaaaccgttncctaaggacgaagtccggaggaccgaacggttgtaag

SEQ ID NO: 441354 - DNA, 606 bp, Homo sapiens
  misc_feature: GZ8MTXP01BBXFZ.11.57.F02.1.454.CMB.2.raw
  modified_base (206)..(206): a, c, t, g, unknown or other
  modified_base (267)..(267): a, c, t, g, unknown or other
  modified_base (405)..(405): a, c, t, g, unknown or other
  modified_base (579)..(579): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtaggggaaacngtccaccctctcctgcagggccagtacaaaatattaaacaactacttagcctggtaccaanagaaacctggccaggctcccaggctcctcatctaatgatgactagtttaggagggccacgtggaccactccccgacctagggtttcagggttggacctagggtcgggtctcggggtaacaggtactttcaatttcccncaacccgtatcccggacacggtccctaagacgtacctagaagtactttgactaagttttactactgttacaacgagtcgtagcaagcgacggccgtccggcgtaccggttcggaccgaagggtaccgaagggtacggaagtcgaagtcgaacggttgtcggcgtagcaccgttnccttgtctcactccttcctcaacgtcg

SEQ ID NO: 441355 - DNA, 612 bp, Homo sapiens
  misc_feature: GZ8MTXP01CZLAF.11.57.F02.1.454.CMB.2.raw
  modified_base (206)..(206): a, c, t, g, unknown or other
  modified_base (249)..(249): a, c, t, g, unknown or other
  modified_base (257)..(257): a, c, t, g, unknown or other
  modified_base (263)..(263): a, c, t, g, unknown or other
  modified_base (275)..(275): a, c, t, g, unknown or other
  modified_base (277)..(277): a, c, t, g, unknown or other
  modified_base (531)..(531): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctccgtggggaaacngtccacctctcctgcaggccagtacaaatataacaactactanctgtcaanagaacngcagctccagcncnatctatgatgctagtttaggacggccacgtcggcactccccaccgtaggtttcaggtggtacgtaggtgggtacgtacggggaactagtactttacgactttacctaccaaccaactcccgaccacgtacctaggacgtccgtagtaaacgttattttgacttaagttttaactacgttacgtacaaacgtgacgtagacgagcgacgggtccctacgggcggtacgtccggacgaacggaacgaggtcgtaanaccgaaggcgtaagttgggtcggacgtggaccacgttcttctaacgtcttcctcgttacccttcccgtaacttcgttaacg

SEQ ID NO: 441356 - DNA, 696 bp, Homo sapiens
  misc_feature: GZ8MTXP01B586U.11.57.F02.1.454.CMB.2.raw
  modified_base (204)..(204): a, c, t, g, unknown or other
  modified_base (263)..(263): a, c, t, g, unknown or other
  modified_base (284)..(284): a, c, t, g, unknown or other
  modified_base (288)..(288): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctgctccagataccacggagaaattgtgttgacacagtctccggccaccctgtctgcgtcgtccgtaggggaaacngtccaccctctcctgcgagggccagtacaaaatataaacaactacttagctgtaccaanagaacctgcaggctccgagcncctnatctatgatgactagtttaggacggtccagtcggacctaactcccccgaaccgtagggtttccaagggtcggctagggtcggggtcctaggggaacctaggtacctttcactttaccaccgaacctactcccgacacgtaccgttaaggacgtacccgttagtaaaggttacttttacgatttacgttttaattacgttacgtaacaaacgagtacgttagacgaacgcgggaacggtccggtccggacggtaccgttcggaaccgtaagggaaccgaagggtaagggaacgtacgaaacggtcggaaacgttcgggtacgacgttacggacccttaaccgttagttccgtttaacggttccctttaacgtaacccttcccgttaccccggtaaccttaacgtttccg

SEQ ID NO: 441357 - DNA, 574 bp, Homo sapiens
  misc_feature: GZ8MTXP01BF5OZ.11.57.F02.1.454.CMB.2.raw
  modified_base (204)..(204): a, c, t, g, unknown or other
  modified_base (571)..(571): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaaacaactacttagcctggttccaacagaaacctggccaggctccaggctcctcatctatgatgcagtttagggagggccacgtggccactcccccacccgtaggttcagtggcaggtggggtctggggactagacttcatttcacaacctatcccgcacgtcctagacgcctagaaacgtattttgactagttttacttactgttacaacgtagcgttagcaagcgaaggtcccgtccggcggtacgtcggaccgaacgggaccagggtggaagtcgaacgcgaaacgttggtcggcgtgcgaccttattctgtcttcatcccttcccgcttntcg

SEQ ID NO: 441358 - DNA, 615 bp, Homo sapiens
  misc_feature: GZ8MTXP01CD27L.11.57.F02.1.454.CMB.2.raw
  modified_base (263)..(263): a, c, t, g, unknown or other
  modified_base (287)..(287): a, c, t, g, unknown or other
  modified_base (294)..(294): a, c, t, g, unknown or other
  modified_base (358)..(358): a, c, t, g, unknown or other
  modified_base (368)..(368): a, c, t, g, unknown or other
  modified_base (374)..(374): a, c, t, g, unknown or other
  modified_base (422)..(422): a, c, t, g, unknown or other
  modified_base (488)..(488): a, c, t, g, unknown or other
tcagcgagagataccacgaccggtgctcgatttagctcgatatagttgggtttgggggaggaactgctcagttaggacccagagggaaccatggaagcccagctaagcttctcttcctcctgctacactggctccagataccaccggagaaattgtgttgacacagtctccggccaccctgtctgcgtctccgtggggaaacagtccaccctctcctgcagggccagtacaaaatattaacaactacttagcctggtaccaanagaaacctggcaggctccagctcncatctangatgcatttaggaggccactggcactccaccgagttcagtgcaggtggctgggaccagtacttnattctacacntccganacgtcctagacgctagatatttggactagtttattactagtacctaanggctagcgagcgacggggtccgtcggaccgtacggttacggaccgaaacggggacttaaacggggnggtaaacgtacgaaacggacggtaaccgtgggttcgggtacaggtacccgtaaccttaacttcgttacggtttaaccttaaccgtaacttcccgggtttccccgacccgttaagttcccttaacggg

SEQ ID NO: 441359 - DNA, 603 bp, Homo sapiens
  misc_feature: GZ8MTXP01D03EX.11.57.F02.1.454.CMB.2.raw
  modified_base (241)..(241): a, c, t, g, unknown or other
  modified_base (262)..(262): a, c, t, g, unknown or other
  modified_base (289)..(289): a, c, t, g, unknown or other
  modified_base (309)..(309): a, c, t, g, unknown or other
  modified_base (353)..(353): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacgacggtacgtgctgttgtactgcctcctccgnggtctttgtcttggctattangccaccctccacgcctcacgtacagtnaactgacctcgaggtctcgngctcaccgtccaccaccacgcatcgtcgacctcgacggggtccncgaggcctcccgaggggtagggctaggaatggatttcatactattagctaggtgtggtcgcgactatactactacgacagtactcgtagtacgaagggtcctattcactcactcaccgaagacaacgaagtcggaaccaaactactcaacgttcgttaattaccgttaaggaaaacttcgaaaccgttacgttacccgtaagggaagtaacgggtacggaacgggttaccgtaacggggttctttaaagg

SEQ ID NO: 441360 - DNA, 565 bp, Homo sapiens
  misc_feature: GZ8MTXP01AGSIW.11.57.F02.1.454.CMB.2.raw
  modified_base (203)..(203): a, c, t, g, unknown or other
  modified_base (263)..(263): a, c, t, g, unknown or other
  modified_base (384)..(384): a, c, t, g, unknown or other
  modified_base (535)..(535): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaaacaactacttagcctggttaccaanagaaacctggaccaggctcccaggctcctcatctatgatgctatttagggaggccagtggcactccccaccaggttcagtgcaggtgggtctgggacagtacttcattcacaaccatccgnacgcctagcgctagtaagtatttgactagtttattactgtacaacagcgtagcgagcggaacggccgtccggacgacgttccggaccgaaaggggaccgaagggtaggaaacgtacgaaggaacgaacgttggtacgcgtcgacaccgttnttctgtcttctactccttccgcttaagtcg

SEQ ID NO: 441361 - DNA, 645 bp, Homo sapiens
  misc_feature: GZ8MTXP01D4HAE.11.57.F02.1.454.CMB.2.raw
  modified_base (205)..(205): a, c, t, g, unknown or other
  modified_base (260)..(260): a, c, t, g, unknown or other
  modified_base (278)..(278): a, c, t, g, unknown or other
  modified_base (280)..(280): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctaggggaaacngtccaccctctcctgcagggccagtacaaaatataacaactactagctgtccaanagaactgcagctccagcncnatctatgatgctagtttaggacggccacgtggacactccccaccgaggttcaggtcggctaggtcgggtctacggggactagtacttctattccaccaaccagtcccgacacgccgttaagacgtacctagtaagttagtttgacttaagtttattaacgtgtaactaacgagtaccgtagacgagacggtaacggtcccgttccgggaccggtaaccggttccgggaacccgaaaggggtaacccggaaaggggtacggtaaacgtacgaaacggtaacgtaaacggttggtcggttacgtacgtaccgacttacgttccgttcgttaccttaactacgtcccgttaccccgcgttaacttccg

SEQ ID NO: 441362 - DNA, 648 bp, Homo sapiens
  misc_feature: GZ8MTXP01ENAAT.11.57.F02.1.454.CMB.2.raw
  modified_base (311)..(311): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgctatttagaaggtgtccagtgcgaggtgcaagtggtgcagtcgtgggggagcttagtccgaggcccgggggggtcctgacgactctcctgtctagtctcgtggattcgcctcagtgactatgccagtggaaggtcgggtccnccgaggcctaccgaagggtaaggggctagggaatggtatttcatacagtttacgctaggttaggtggtcgaaccgtaacctaattactaaccgtaccgctaagtacttcgtaggtacggaacgggcctaattcaattactacttacctaccaagacgaaccaagtacggaacctaaacgaacttctaaccttggtaactaccgtaaggtaaacttaccgaaacacgtaccgtaggaaggaaccggtgggaacggtaccgacggtcttaaggttaatttatttagttggtacggccgacggacccggttacccccgttaaggggttccgtaacccggg

SEQ ID NO: 441363 - DNA, 605 bp, Homo sapiens
  misc_feature: GZ8MTXP01ESD2D.11.57.F02.1.454.CMB.2.raw
  modified_base (206)..(206): a, c, t, g, unknown or other
  modified_base (266)..(266): a, c, t, g, unknown or other
  modified_base (289)..(289): a, c, t, g, unknown or other
  modified_base (293)..(293): a, c, t, g, unknown or other
  modified_base (383)..(383): a, c, t, g, unknown or other
  modified_base (385)..(385): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtcaccctctcctgcagggccagtacaaaatattaaacaactacttagcctggtaccaanagaacctggccaggctccaggcncctnatctatgatgctatttagggacggccagtggcactccccaccgtaggtttcaggtggcaggtcgggtctggggactagtacttcattccncnccatcccgcacgtcctagacgtcctagtaagtagttttcgcttaagtttacttactgtacaacgagtcgtagacgacgcgacggtccgtccggcggtaccggttccggacgaacgggaaccgaagggtagaacgtacgaaggaacgtaacgttgggtcgcgtacggccacgttcttcgttgttaccttccgtacttcccgttacccgtcttaacgttccg

SEQ ID NO: 441364 - DNA, 747 bp, Homo sapiens
  misc_feature: GZ8MTXP01CC4L7.11.57.F02.1.454.CMB.2.raw
  modified_base (206)..(206): a, c, t, g, unknown or other
  modified_base (264)..(264): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccacctctcctgcaggccagtacaaaatattaacaactactagcctaggtaccaanagaacctggaccaggctccgagctcctcatctatgatgacgtagtttagggacgggtcctagtcggacctacgtaccccaacccgtagggtttacagggttcggacgttaggtcggggttcgtaccggggaactacggtactttacgtactttaccctaccgaacccgtacgttaccccgggactaaacggtaccccgttaaaggaccgtacccgtttaaggtaaagtttacgtttttcgaaccgttttaaagtttttaacgttacgttcgttaacaaacggacgttaccgtagacgtaacggcgggtaaccgggtccggtaccgggtaccggtacgttacccggggaacgaaacggggtaaaccgtagggtaggtaaacgtcgtaaacggaacggtaacgttgggtacggcgtacgtcccgaaacgttcttaccgttgttacccttccgtacttcccggttacccctcgttaatttaacccg

SEQ ID NO: 441365 - DNA, 689 bp, Homo sapiens
  misc_feature: GZ8MTXP01BS8EJ.11.57.F02.1.454.CMB.2.raw
  modified_base (204)..(204): a, c, t, g, unknown or other
  modified_base (261)..(261): a, c, t, g, unknown or other
  modified_base (274)..(274): a, c, t, g, unknown or other
  modified_base (280)..(280): a, c, t, g, unknown or other
  modified_base (282)..(283): a, c, t, g, unknown or other
  modified_base (287)..(288): a, c, t, g, unknown or other
  modified_base (291)..(292): a, c, t, g, unknown or other
  modified_base (301)..(301): a, c, t, g, unknown or other
  modified_base (313)..(313): a, c, t, g, unknown or other
  modified_base (321)..(321): a, c, t, g, unknown or other
  modified_base (339)..(339): a, c, t, g, unknown or other
  modified_base (359)..(359): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccggccaccctgtctgcgtctcctggggaaacngtccaccctctcctgcagggccagtacaaaatataacaactacttagcctgtccaanagaacctgcagcnccagcncnntcannatnnagtttaggnggccagtgcacncccaccgngtcagtgcaggtggtcgnggacagtacttcactcctcncctatcccgacacgtcctagcgtcctagtaacgttatttacgacttagttttaacttacctaggttaaccaaacgtagtaccgtaagacgtaacggccgggtaacggtccccggtacccggggtacccggttaacccgggttacccgggaacccggtaaacgggggtaacccgaaaggggttacgggaaacgttaaccgaaacgggtaaccggtaaaccggttgggtacggttaccgttacggaccccttaaaccgttcgtttccgttaacggttacccgtttaactaacccgtttcccgttaccccggtaacccttaacgttttcccgg

SEQ ID NO: 441366 - DNA, 632 bp, Homo sapiens
  misc_feature: GZ8MTXP01DFHK5.11.57.F02.1.454.CMB.2.raw
  modified_base (204)..(204): a, c, t, g, unknown or other
  modified_base (283)..(283): a, c, t, g, unknown or other
  modified_base (286)..(286): a, c, t, g, unknown or other
  modified_base (382)..(382): a, c, t, g, unknown or other
  modified_base (404)..(404): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctctggggaaacngtccaccctctcctgcagggccagtacaaaatattaaacaactactagcctgtacaacagaaacctgcaggctccagcnctnatctatgatgctagtttaggagggacctactcggctactaccccaccgtaggtttcaggtgcgaggtggtcgtacggggacagtactcattccacnccatcccggacagccctagacncgtagagtatttgctagtttattacgtgttaccaacgagtcgtacgcgacgcggtaacggtccccgttaccgggacgtaccggttaccggaccgggtaaacgggaaccggtaagggtacggtaaagaccgaaaggaaccggtacgttagggtcggcgtacggacccttaccgttcgttccgttaacgtttccttctaaccgttcccttacccgtcccgttaacttccg

SEQ ID NO: 441367 - DNA, 565 bp, Homo sapiens
  misc_feature: GZ8MTXP01DCIAR.11.57.F02.1.454.CMB.2.raw
  modified_base (310)..(310): a, c, t, g, unknown or other
  modified_base (520)..(520): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgcttattttagaaggtgtccagtgcgaggtgcaagtggtgcagtcgtgggggagcttaggtccgaggccggggggtccctggagtactctcctgtctagtctctggattcgcctcagtgactatgccatgaagtcgggtccnccaggctccgaggtaagggggctagggaatggtatttcaattacattacgcagtagtggtcgaacgaccaattatactacgcagtactcgtgagaagggcctattcatcatctccaagacgaacaagtgaaccaacgaactcaacttagtataccgtaggaaacttacaacagctaggaagtaacggcgaggacacggtcttagttattnttagttggagccggtaacgccggttacccccgtggcgtaaccggg

SEQ ID NO: 441368 - DNA, 516 bp, Homo sapiens
  misc_feature: GZ8MTXP01EJQD0.11.57.F02.1.454.CMB.2.raw
  modified_base (443)..(443): a, c, t, g, unknown or other
  modified_base (466)..(466): a, c, t, g, unknown or other
  modified_base (484)..(484): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctatttagaaggtgtccagtgcgaggtgaaagtggtgcagtcgtgggggagcttagtccaggccggggggtccctgagactctcctgtctagtctctggattcgccttcagtgactatgccatgaagtggtccgcaggctccgaggtaaggggctggaatggatttcatacattagcagtagtggtgcgaaccataatactacgcagactctgtagaggcgattcatcatctccagagacaatgacaacactcactgtatctagaaatcaaacngcctagagagtcgaggacacggntgtaagttattattgtgngaacgacgccccgttaggtcgaacgtccgggg

SEQ ID NO: 441369 - DNA, 526 bp, Homo sapiens
  misc_feature: GZ8MTXP01AJTE9.11.57.F02.1.454.CMB.2.raw
  modified_base (479)..(479): a, c, t, g, unknown or other
  modified_base (491)..(491): a, c, t, g, unknown or other
  modified_base (498)..(498): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctggtttccttgttgctatttagaggtgtccagtgcgaggtgcaagtggtgcagtcgtgggggagcttagtccgaggccggggggtccctgagactctcctgtctagtctctggattcgcctcagtgactatgccatgaagtgggtcccgccaggctaccgaggttaagggggctgggaatggtatttcgatacattacgcaggtagtggtgaccgaccaagtatactacgcagactcgtgtagagggccattcatcatctaccagagacaagtgacaacaactcactgtatcgtagaaatacaaactgcctgagaacgtcgaggacnggctggttattnttattgngcgagccgaccccgtaaggttcgaacgg

SEQ ID NO: 441370 - DNA, 643 bp, Homo sapiens
  misc_feature: GZ8MTXP01BNBYO.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagtcttagtccgagggcccggggggtcctgacgtactctcctgtctagtctctggtacttcgcctcagtgactatgccagtgaaggtcgggtcccgccgaggcctaccgaaggggtaacggggctagggaagtggtatttcgatactagttacgacgtaggtaggtggtcgaaccgaacctaatactaccgtacgacacgtactcgtagtaggaacgggcctatcaatctaatcctacagagacaagtcgaaccaaacgtactcacttagtaactcgtaagaaactaccgaaagtccgtaccgtaggaacggtaacggtacggaaacggtaccgacgggtaccttaagttaactttagtttacggttaaggtcggaacgtaacggtaccccggttacccccgttaagggttcgtaacccggg

SEQ ID NO: 441371 - DNA, 518 bp, Homo sapiens
  misc_feature: GZ8MTXP01EGWCG.11.57.F02.1.454.CMB.2.raw
  modified_base (262)..(262): a, c, t, g, unknown or other
  modified_base (284)..(284): a, c, t, g, unknown or other
  modified_base (476)..(476): a, c, t, g, unknown or other
  modified_base (489)..(489): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctgcaggctccaggcnctcatctatgatgctatttaggaggccatggcactcccaccaggttcagtgcagtggtctgggacagacttcattcctcaaccatcccgacacgcctagacgtcctagaagtatttgctagtttattactgtacaacagcgtagcagcgaggccgtccgcgacgtcgacgaggaccaggtgagtcagcacgnggtgcgtgcacgnttcgtgtctctatccgttaccgtcaagtc

SEQ ID NO: 441372 - DNA, 712 bp, Homo sapiens
  misc_feature: GZ8MTXP01BUEG7.11.57.F02.1.454.CMB.2.raw
  modified_base (205)..(205): a, c, t, g, unknown or other
  modified_base (292)..(292): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctcctggggaaacngtcaccctctcctgcagggccagtacaaaatataaacaacttacttagcctggttaccaacagaaacctgccaggctcccagctccnatctatgatgactagtttaggacggcctacgtggccactccccaccgtagggtttcaggtcggctaggtgggtcgtaggggactagtacctttctatttacccgtacctaaccacgttcccgacgtaacgtcccccgttaaagggacgtacccgttaggtaaacgtttacgtttttacgacgttttaaagggtttttaacttttaaccgttacgggttaacctaaaccgtaggtaccgttaagaccgtaacgccggggtaacggtccccgtaccgggaccgtacggttccggacccgaaagggaacccgaagggtaggaacgtacgaaacggtcgaaacgttgggtcgttcgtacgccaacccgttgttccgtttccgttccgttctacccttccgttccccgtaaccttcgtttaaccg

SEQ ID NO: 441373 - DNA, 738 bp, Homo sapiens
  misc_feature: GZ8MTXP01B7J3J.11.57.F02.1.454.CMB.2.raw
  modified_base (206)..(206): a, c, t, g, unknown or other
  modified_base (266)..(266): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtcctccggccaccctgtctgcgtctccgtaggggaaacngtccaccctctcctgcagggccagtacaaaatattaaacaactactagcctgttaccaanagaacctgccaggctcccagcnccnatctangatgactagtttaggacggccagtggaccactccccaccgtaggttcaggttcggcgtaggtcggggtctaggggactaggtacctttcgactttccaccgaaccctacgtcccgactaccggtaccttaacgggacgtacccgttaagtaaagtttagttttcgacgtttaaaggtttttaacttacgttacggttaaccaaacgtacgggtaccgttaaggaccgttaacgggcccggtaaaccggggttcccccgttaccgggggacccggttaaaccggggtttacccgggaaacccggaaaacggggaacccgtaaaggggtaacgggaaacgttccggaaacggaacgtaaacggttcggtaggccgtacggaccttaacgttcgttacgttccgttacttcctacgttccccgtttaccccgcttaacgttccg

SEQ ID NO: 441374 - DNA, 661 bp, Homo sapiens
  misc_feature: GZ8MTXP01BOAAU.11.57.F02.1.454.CMB.2.raw
  modified_base (240)..(240): a, c, t, g, unknown or other
  modified_base (601)..(601): a, c, t, g, unknown or other
  modified_base (624)..(624): a, c, t, g, unknown or other
  modified_base (656)..(656): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgnggtctttgtcttggctattatgccaccctccacgcccgtccacgtacctagtcgtaacttcgacctgtacggttcttcggtcggcctccgaccgtcccaacccacacgctagttcggtaccgaccgtcgggacgggggtcccaccggacggtcctaccccgggaagggggtacggggtctaagggtaacgttcggttaactttcaattaacctagttacgacgtagggtaggtcggacgaccgaactatactaccgtacgacgtagtacttcggtagaacgggaacgggtccttaatttacgacttacacttcccgaacgaaggactaactaaggtcaaaccaaaccttactcctaagttnacgtacgttaagaaactcgaacncggactaaggagcggtacgacggactcggttnttaag

SEQ ID NO: 441375 - DNA, 567 bp, Homo sapiens
  misc_feature: GZ8MTXP01B9LVW.11.57.F02.1.454.CMB.2.raw
  modified_base (236)..(236): a, c, t, g, unknown or other
  modified_base (263)..(263): a, c, t, g, unknown or other
  modified_base (292)..(292): a, c, t, g, unknown or other
  modified_base (368)..(368): a, c, t, g, unknown or other
  modified_base (376)..(376): a, c, t, g, unknown or other
  modified_base (402)..(402): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatnttaaacaactacttagcctggtccaanagaaacctggccaggctcccaggctcctnatctatgatgctagtttaggaggccacgtggcactcccaccagttcagtgcagtggtctggacagactcatcctcncatcccgnacgcctagacgcctagaagtctttancttagtttattactgttacaacagcgtagcagcgacggccgttcccggacgtacgttccggaccgaagggaaccgaaggtggaaacgtcgaaggtaacgaacgttggtacggcgtacgccacgttacttcttaagtcttctactccttccccgtcttaacgttcg

SEQ ID NO: 441376 - DNA, 636 bp, Homo sapiens
  misc_feature: GZ8MTXP01DVL0T.11.57.F02.1.454.CMB.2.raw
  modified_base (261)..(261): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (288)..(289): a, c, t, g, unknown or other
  modified_base (291)..(292): a, c, t, g, unknown or other
  modified_base (300)..(300): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacagtccaccctctcctgcagggccagtacaaaaatataaacaatacttagcctgtacaanagaactgcagctccagcnccnatntanntnntagtaggngcatgacactcccaccgtaggttcaggtggactagggttcgggtacgtacgggactaagtactttctacttccaccaaccgtactcccgacaacgtacccgtaagacgtacctagtaaagttatttgtacttaagtttaacttaactagtaacaaacgagtacgtagacacgacggacggcccgtaccggacggtacgtccggacgaaacgggaaaccggtaaggtaaggaaacgtaacgaaaggtaacggaacgttaggtcggttacgtacgaccaaccgttcttacgttcgttaccgtttcctacttcccgttacccgtaaccttaacgttccg

SEQ ID NO: 441377 - DNA, 584 bp, Homo sapiens
  misc_feature: GZ8MTXP01EHEMT.11.57.F02.1.454.CMB.2.raw
  modified_base (203)..(203): a, c, t, g, unknown or other
  modified_base (263)..(263): a, c, t, g, unknown or other
  modified_base (289)..(289): a, c, t, g, unknown or other
  modified_base (376)..(376): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacngtccaccctctcctgcagggccagtacaaaatattaacaactacttagcctggttccaanagaaacctggccaggctccagctccncatctatgatgctagtttaggagggccatggcactccccacctaggttcagtggcaggtgggtctgggacagtactcattccctacncctatcccgacacgaccctagacgtcctagaacgtatttgctaagtttattactgtacaacagacgtagacagcggacggaccgttccggacgtaccgttcggaccgaaaggggaacccgtaaaggggtaggaaacgtccgaaaggcgtaaacttggtggacgtggccttacgacttctgttctctactccttaccgtccttaagtcg

SEQ ID NO: 441378 - DNA, 668 bp, Homo sapiens
  misc_feature: GZ8MTXP01DTVO9.11.57.F02.1.454.CMB.2.raw
  modified_base (204)..(204): a, c, t, g, unknown or other
  modified_base (263)..(263): a, c, t, g, unknown or other
  modified_base (283)..(283): a, c, t, g, unknown or other
  modified_base (285)..(285): a, c, t, g, unknown or other
  modified_base (475)..(475): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaaatataacaactacttagcctggtaccaanagaacctgcaggctccagcncnatctatgatgactagtttagggcgggtcctagtcggactacgtaccccacccgtaggtttcgaggtggacgtaggtggggtcgtacggggactaggtacctttacactttcctaccaacctacgtccccgacacggtacccttaaggacgtcctagaaacgtttatttcggacttagttttactacgttntaacaactagccgtaagcgaacgcggtacggtacccgtccggtaccggtacggttacccggacgtaaacggggaccgaagggtggaaacgtcgaaaggcgtaaacgttgggtcggttacacggtccttaaacccgttgttccgttggttccctttaacgaacctttccccggttaacccccgcgttaacgtcg

SEQ ID NO: 441379 - DNA, 537 bp, Homo sapiens
  misc_feature: GZ8MTXP01D1X5U.11.57.F02.1.454.CMB.2.raw
  modified_base (456)..(456): a, c, t, g, unknown or other
  modified_base (479)..(479): a, c, t, g, unknown or other
  modified_base (493)..(493): a, c, t, g, unknown or other
  modified_base (502)..(502): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtcctgagactctctgtctagtctctggattcgctcagtgactatgccatgaagtggtccgcaggctaccgagggtagggctggaatggtatttcgatacattacgctagtagtggtgacgaccaatatactacgcagactctggtagaagggccattcatcagtctcagagaacaagtgacaaactactactactagtatctagaaactacaacncgcctagacgaagtcgaggaccncggtctagttattnttagttcgngtcgacgaccgttccccgtaaggttcgaacccggg

SEQ ID NO: 441380 - DNA, 616 bp, Homo sapiens
  misc_feature: GZ8MTXP01B0W82.11.57.F02.1.454.CMB.2.raw
  modified_base (402)..(402): a, c, t, g, unknown or other
  modified_base (506)..(506): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttaggtccgagggcccggggggtccctgacgactctcctgtctagtctctggtattccgccttcagtgactatcgccagtggaaggtcgggtcccgccgagggcctaccggaaggggtaacgggggctagggaatggtatttcatactagttacgctagtagtcggtgaaccgaacctntatactacgcagtactgtgagaacggcctattcattcacgtcaccgagacgtaacaagtcgaaccaaacgaactctaacttgtaactcgtaagaaataccaacncgtcctaggagtaacggtacggacggacttacgggtcttgttaattgtttagttgggacgaaccggtaacggaccccgttaccccggttaacgggttcgtaaccccgggg

SEQ ID NO: 441381 - DNA, 619 bp, Homo sapiens
  misc_feature: GZ8MTXP01AQ27M.11.57.F02.1.454.CMB.2.raw
  modified_base (261)..(261): a, c, t, g, unknown or other
  modified_base (282)..(282): a, c, t, g, unknown or other
  modified_base (285)..(285): a, c, t, g, unknown or other
  modified_base (306)..(306): a, c, t, g, unknown or other
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacggagaaattgtgttgacacagtctccggccaccctgtctgcgtctccgtggggaaacagtccaccctctcctgcagggccagtacaaaatataacaactactagcctgtaccaanagaacctgcaggcctccagcnccnatctatgatgctagtttaggnggccacgtgcactccccacgtgttcaggtgcaggtgggtctacgggacagtacttcatttccaccnccagtcccgacacgtcctagacgtcctagtaagttatttcgacttaagtttattaacgttgtaacctaacgcgtacgtagacacggacggacggtcccggtccggaccggtaccggttccggaaccggaaagggaaccgaaggggtcggtaacgtacggaagtaaccgtaacgttcgggacgcgtacgcaacccgttgttccttggttccttccgtacttcccggttaccccgaacgttaaccttgg

SEQ ID NO: 441382 - DNA, 704 bp, Homo sapiens
  misc_feature: GZ8MTXP01A2ILQ.11.57.F02.1.454.CMB.2.raw
  modified_base (266)..(266): a, c, t, g, unknown or other
  modified_base (290)..(290): a, c, t, g, unknown or other
  modified_base (296)..(296): a, c, t, g, unknown or other
  modified_base (661)..(661): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacagtccaccctctcctgcaggccagtacaaaatattaacaactacttagcctggtaccaanagaacctggccagctccagctccnatctangatgactagtttaggagggcccacgtggaccactcccccaaccgtagggtttcaggttcggcgtagggtcggggtctcggggaacctaggtacctttcaactttccctaccaacccgtactccccggacctacgtaccccgtaagggtaccgtacccgttaggtaaacgttagtttttacggactttaagtttttaacttaacgttacgttaccaaacgtacggtaccgtaagacaacgggtccggaaccgggtccccggttacccggaccgggtaccgttcccggggaaccgtaacgggaaccgaagggttacggaacgttacgaaaggtaaccgtaacgttgggcggcgtcgacttaccgttnttcgttcgtcctttcaccttccgttccccgtcttaacgttccg

SEQ ID NO: 441383 - DNA, 629 bp, Homo sapiens
  misc_feature: GZ8MTXP01A7R7T.11.57.F02.1.454.CMB.2.raw
  modified_base (248)..(248): a, c, t, g, unknown or other
  modified_base (314)..(314): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttatttagaggtgtccagtgcgaggtgcaaggtggtgcaggtcgtgggggagtcttagtccgaggccggggggtccngacgctctcctgtctagtctcgtggattccgctcagtgactatcgccagtggaaggtcgggtcccncgaggctccgaaggggtagggctagggatggatttcatacattacgctagtagtggtgaaccgaacctaatataactacggacagtactcgtggtagaacgggtacctagttcatctacttacctaccaaggacaacaagtacgtaccaaacgtactactaactacgtaatacgtaggtaaactacgaaacacgacccgtagaacggaacggtcggaacggaaccgttacggtacttaggttaaatttgtttacgttaaggtacgaacgtaaccggtaccgttacccccggttaagggttaaccggtaacccggg

SEQ ID NO: 441384 - DNA, 673 bp, Homo sapiens
  misc_feature: GZ8MTXP01D7FXC.11.57.F02.1.454.CMB.2.raw
  modified_base (207)..(207): a, c, t, g, unknown or other
  modified_base (261)..(261): a, c, t, g, unknown or other
  modified_base (282)..(282): a, c, t, g, unknown or other
  modified_base (284)..(284): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccacctctcctgcaggccagtacaaatataacaactactagcctgtaccaanacgaacctgcaggctccagcncnatctatgatgactagttagggcggccagtcgactactccccaccgtaggtttcaggtcggacgaggtgggtacgtacgggactaacgctttcaacttccctacaaccgtactcccgacgtacgccgtaagacgtaccgtagtaacgttatttcggatttagttttaattaccgtggttacaacgtggaccgtagaccgtaacgccggtaacggggtccccgtccggggtaccggtaaccggtccgggaacccgggtaaacggggaaacccgtaaagggggttacgggtaaacgttaccggaaaggtaaccgggtaaccgttgggtacgggacttcgaccgttacttacggttcttcgttacttcctagtcccttcccgcttaaccgttg

SEQ ID NO: 441385 - DNA, 661 bp, Homo sapiens
  misc_feature: GZ8MTXP01CC0FN.11.57.F02.1.454.CMB.2.raw
  modified_base (205)..(205): a, c, t, g, unknown or other
  modified_base (251)..(251): a, c, t, g, unknown or other
  modified_base (259)..(259): a, c, t, g, unknown or other
  modified_base (274)..(274): a, c, t, g, unknown or other
  modified_base (277)..(277): a, c, t, g, unknown or other
  modified_base (280)..(280): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtaggggaaacngtccaccctctcctgcagggccagtacaaaatataacaactactanctgtcaanagaactgcagctccngcnctnatctatgatgactagtttaggacgggccagtcggcactccccaccgtaggttcaggtggcgtaggtcgggtcgtacggggactagtacttcacttcctacaaccacgtccgacacgtccctaaggactcccgtagtaaacgttatttacggacttaggtttttaactacgttcgtaactaacgagtcgttaagcgtacggtacgacgggtcccgttacccgggacgtaaccggttaccgggaacccggaaacggggtaacccgtaaaggggtacggaaacggtacgaaacggtccggtaaacgttggggtaacgcgttacgcgaacccgttgttccttgtacctttaactacgttcccgttacccggtcttaacggttccg

SEQ ID NO: 441386 - DNA, 619 bp, Homo sapiens
  misc_feature: GZ8MTXP01DRGF8.11.57.F02.1.454.CMB.2.raw
  modified_base (204)..(204): a, c, t, g, unknown or other
  modified_base (280)..(280): a, c, t, g, unknown or other
  modified_base (294)..(294): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatataacaactactagcctggtccaacagaacctgcaggctccagcnctcatctatgatgnatttaggagggccagtggcatcccaccaggttcaggtgcaggtggtctgggacagacttcattcctcaaccatcccgacacgccctaggacgtcctagtaagtattttgcttaagttttattaacgtgttacaacgagtcgtagacacgtcggaacggccgttacccgggacgtaccggttccgggaccgaaacggggaacccgaaaggttcgggaaagttaccgaaggtaaccgtaaacgttgggtcggacgttacggccttaaccttcgttccttaaggttacctttcgtaacttcccttacccgttccgttaactttaaccg

SEQ ID NO: 441387 - DNA, 840 bp, Homo sapiens
  misc_feature: GZ8MTXP01BMHNF.11.57.F02.1.454.CMB.2.raw
  modified_base (205)..(205): a, c, t, g, unknown or other
  modified_base (264)..(264): a, c, t, g, unknown or other
  modified_base (295)..(295): a, c, t, g, unknown or other
  modified_base (300)..(300): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcagggccagtacaaaatattaacaactactagcctaggtaccaanacgaaacctggaccaggtcctccgaggtccncctanatctatgatgactagtttaggacggccactggacactcccaccgtaggttcgaggtcggacgtaggtcgggtaccgtggggaactacggtaacctttcctaactttccctacccaacccgtaccgtacccgggacctaaacggtaccccgttaacggggacttaaccccgttaggtaaaacgtttagttttttacgggaccctttaaagtttttacgtttaaaccgttcgtaaacccgtaaacgacgggttaccggttaacggactaaccggggttaccggaaccggggtccccgggttacccgggggtacccgggttaaccccggggtttacccgggaaacccggtaaaccgggggtaaaacccggtaaagggggttaccgggaaaacggttaccgaaaaccggggtaacgtaaaacggttcggggttaacggcccgttacgggaaccccttaaccggttcttaaccccggtttggtttccccgttaacgttaaccccttccccggttttaccccgaacccgttaaacgttttcccggg

SEQ ID NO: 441388 - DNA, 635 bp, Homo sapiens
  misc_feature: GZ8MTXP01A6N10.11.57.F02.1.454.CMB.2.raw
  modified_base (299)..(299): a, c, t, g, unknown or other
  modified_base (435)..(435): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttaccaacagaaacctggccaggctcccaggctcctcatctangatgactagtttagggacgggccacgtcggctactccccaccgtaggttcagtggcaggtcggtcgtacgggacagtacttcattcctacaacctactccgacacgcccgtagacgcccgttagaagttatttcgnttaagtttattactgtacctaacgacgacgtagacgagccgaacgggtcccgtaccgggtaccggacgttccgggaccgaacgggaaccgtaagggtcggtaaacgtacgaaaggccggtaaacgttgggtacgccgtacggtaccacgttcttcgttaaccgttcttctaccgttccgttaccctccgttaacttccgg

SEQ ID NO: 441389 - DNA, 771 bp, Homo sapiens
  misc_feature: GZ8MTXP01A71MI.11.57.F02.1.454.CMB.2.raw
  modified_base (285)..(285): a, c, t, g, unknown or other
  modified_base (294)..(294): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactactagcctgttaccaacagaaacctgccaggctccaggcnctcatctangatgctagtttaggacgggccagtggcactccccaccgaggtttcaggtggactaggtgggtctggggacctagtacgttcacgtttaccacccaaccctagtacccgcctaaccggaccccgttaagggacgtacccgttaagaaacgtttagttttttcggacgttaaacggtttttaactttaaccgtttaacggttaaccaaaacgtacgggtaacggttaacggaccgaacgggacccggtaaccgggggtccccgtttaccccgggggaccggttaacccggggtttacccgggaacccggtaaaacgggggaaccccggttaaaggggtaacggggtaaacgtccggaaaacgggtaaccggttaaacggttgggtacgggttacgttaccggaacccttaccgttactttccgtaacggttaccctttccgtaaccctttcccgttaccccgtcctttaaccggttccg

SEQ ID NO: 441390 - DNA, 761 bp, Homo sapiens
  misc_feature: GZ8MTXP01A33DZ.11.57.F02.1.454.CMB.2.raw
  modified_base (205)..(205): a, c, t, g, unknown or other
  modified_base (261)..(261): a, c, t, g, unknown or other
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaatataacaactactagcctgtaccaanagaacctggcaggctccagctctnatctatgatgctagtttaggacgggtccacgtggccactccccgaccgtagggttcaggtggactaggtcgggtcgtacggggacaggtacttcgtaactttcccaccgaacctacgtccccggactacggtcccgttaaggacgtacccgttaggtaaacgttagtttttcggaccgtttaagttttaacgtttaccgttaggtttaaccaaacggtacggtaccggttaacgaccgtaacggccgggggtaaccggggtccccggttaccccgggggacccgggttaaacccgggtttcccgggggaaacccggtaaacggggggaacccggtaaagggggttaacgggaaacgttaccggaaaacgggtaacggtaaaccggttgggacggttaccgttacgggaacccttaacccttgttcccgttaaggttccttctaccctttcccgttccccgtaaccttaacgttccg

SEQ ID NO: 441391 - DNA, 629 bp, Homo sapiens
  misc_feature: GZ8MTXP01CRD1W.11.57.F02.1.454.CMB.2.raw
  modified_base (286)..(286): a, c, t, g, unknown or other
  modified_base (412)..(412): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagtcttacggtccgagggcccggggggtcctgacgactctcctgtctagtctctggattcgcctnagtgactatgccagtgaaggtcgggtcccgccgagggcctaccgaaggggtaacgggggcctagggtaatgggtatttacattacagttacgctaggtagtggtgaccgaccaatactactacganagactcgtaggtagaacgggcctattcgatcatcctacaagacaacagtcgacaacgtactcctatcgtactacgtaagaaactacaaacgtcgaccgtaggaggtaacggtacgggaaggtaaccgttacgggtacttagttaagtttagtttacgttgggtacgccggtaacggtacccggttaccccccggttaaggggttcggtaaccccggg

SEQ ID NO: 441392 - DNA, 699 bp, Homo sapiens
  misc_feature: GZ8MTXP01C6F42.11.57.F02.1.454.CMB.2.raw
  modified_base (311)..(311): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggcccgggggggtcctgagactctcctgtctagtctcgtggattcgcctcagtgactatgccatgaaggtcgggtcccnccgaggcctaccgaaggttaagggggctagggaatggtatttcaatactattacgctagtaggtggtcgaaccgaacctaattaactaaccgtaacgcaagtaccttcgtaggtaggaacggggtaccgtattaccattaccaattcctaccaaggaacgaaaccaagttacgggaaccaaacgtaaaccttactaaccttaggttaactacgtaagggaaaacttaccgaaacgaaccggtcccgtaggaaacgggtaacggttaccgggaaacggggtaaccgaacgggttaccgttaggttaaatttagtttagtttaacgggtacggccggtaacgggtaccccggttaccccccggttaacgggggttccgtaaccccggggg

SEQ ID NO: 441393 - DNA, 632 bp, Homo sapiens
  misc_feature: GZ8MTXP01EAF8B.11.57.F02.1.454.CMB.2.raw
  modified_base (204)..(204): a, c, t, g, unknown or other
  modified_base (292)..(292): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaaacaactacttagcctggtccaaacagaaacctggccaggctcccaggctccncatctatgatgcatttaggagggtccacgtggacactccccaccgtaggtttcaggtgcaggtgggtctcgggacagacttcattcctacaaccatcccgcacgcctagagccctagaacgtatttgactagttttattactgttacaacagcgtagcaagtcggaacggcccgtccggcgtacgttccggaaccgaagggaaccgtaagggtcggaaagtacgaaacggtaacggaaacgttggtacggttacgtacggaccttaacccgttctttacccgttcggttccctttaaccgttaaccttcccgtttcccccggtccgttaacttttcccgg

SEQ ID NO: 441394 - DNA, 667 bp, Homo sapiens
  misc_feature: GZ8MTXP01D0K3X.11.57.F02.1.454.CMB.2.raw
  modified_base (248)..(248): a, c, t, g, unknown or other
  modified_base (270)..(270): a, c, t, g, unknown or other
  modified_base (300)..(300): a, c, t, g, unknown or other
  modified_base (323)..(323): a, c, t, g, unknown or other
  modified_base (659)..(659): a, c, t, g, unknown or other
tcagcgagagataccacgaccggtgctcgatttagctcgatatagttgggtttgggggcagggtgtacacctgtggttctcggggctgccctttggctttggagatggtttttctcgatggggggctggggagggctttgttggagaccttgcacttgtactccttgccattcagccagtcctggtgcaggacggtgaggacgctgaccacgacggtacgtgcttgttgtactcgccttccgtcccgnggtcttttgtcttggctattangccaccctccacgtcctccacgtaccagtnaacttgacctcgagggtcttcgngctcaccgtccaccaccagctagtcgtcgacccgtcggacgggggtcccacgtaggccttacccggaaggggtaacggggctagggaaattcgggtaacttttcgaaattacctaagtttacgcgtaagggtaggttggtacgacgaacctatactaacgtacgacatacgtcgaggtacggaacgggtacctattacgaacttcaacttccaccgaagtaacgaactaaacgtcgaactaaactaacttccaacttgttaacgttacgttaaaggtaaactcgaaaacgcggttaccgtaagaaacggtcggtacggacggacgtaaccgggttnttttaagg

SEQ ID NO: 441395 - DNA, 871 bp, Homo sapiens
  misc_feature: GZ8MTXP01CEGJQ.11.57.F02.1.454.CMB.2.raw
  modified_base (291)..(291): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaacttacttagcctggtccaacagaaacctgcaggctccaggctcctnatctatgatgctagtttaggagggtccacgtggaccaacttcccccgaccgtacgggtttcaacggttgggaccgtaagggttcgggggttaccgtaccggggggtaaccaacgggttaaccgtttttacccgaaacgtttttccccgttacccgtaaacccctaaacgtttccccccgggtaccaaaccgggtacccccgtttaaaggggaaacccgttcccgttaagggttaaacgtttaaacggttttttggaacctttaaaggttttttaacttaaaccgtttcgggtttaacctaaaccggaggtacggttaaacgtccgtaaacggtccggggaacgggtacccccggtttccggggacccggttaaccgggtttacccggggaaaccccggtaaaggggggaaaccccgtaaagggggttacggggtaaaccgtacggtaaaacggaaccgggtaaaccgtttggggtcggggaaaccttcgggaccttaaaccccgttattacccgtttccgggttcccttttaaaccgaccctttccttaacccccgggtcccctttaagggtttaacccg

SEQ ID NO: 441396 - DNA, 681 bp, Homo sapiens
  misc_feature: GZ8MTXP01CCV77.11.57.F02.1.454.CMB.2.raw
  modified_base (264)..(264): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtacaaaatattaaacaactacttagctggtaccaanagaaacctggccaggctccgaggctcctcatctatgatgctagtttaggaggccagttcgcactccccaccgtaggttcaggtcggactaggtcggggtcgtacgggactagtatttcacttcctacaaccatcccggacacgtcctaaggacgtaccttagtaaagttattttcggactttaagtttttaacttacgttcgtaaccaaacgacgtacgttaacgacgacggtacggaaccggggtccccgttaccgggaccggttaccggttacccggaaccggaaacggggtaaccgtaaggggtacggaaacgtacgaaacggaacggtaacgttggtacggccgttacggcccaccgttagttccgttaacgttccttaacgtaccttcccgttacccgaacccttgtaaccg

SEQ ID NO: 441397 - DNA, 661 bp, Homo sapiens
  misc_feature: GZ8MTXP01AN1X4.11.57.F02.1.454.CMB.2.raw
  modified_base (287)..(287): a, c, t, g, unknown or other
  modified_base (366)..(366): a, c, t, g, unknown or other
  modified_base (368)..(368): a, c, t, g, unknown or other
  modified_base (378)..(378): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggtaccaacagaaacctggccaggctcccagcncctcatctatgatgcatttaggaggccactggcactccccaccaggttcagtgcagtgggtctgggacagactcattcncnccatcccganacgtcctagcgcctaggaactattttgactagttttatactgtacaacgagacgtagcaacgcgggaacggtcccgttccgggaccgtaaccgggttcccggacccggaaaacgggggtaaccctaaagggggtacgggtaaacgtacccggaaacgggttaaccggaaaaccgttgggttaacggggacccttcggggacccaaaccccgttcgttaccgttaaccggtttacccttaaccgtaaccctttccccgttacccccgggtaacttaacgttccg

SEQ ID NO: 441398 - DNA, 703 bp, Homo sapiens
  misc_feature: GZ8MTXP01EIZBL.11.57.F02.1.454.CMB.2.raw
  modified_base (205)..(205): a, c, t, g, unknown or other
  modified_base (292)..(292): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctccagataccaccggagaaattgtgttgacacagtctccggccaccctgtctgcgtctccgtaggggaaacngtccaccctctcctgcagggccagtacaaaatattaacaactattagcctaggttaccaacagaaacctgaccaggctccagctctnatctatgatgactagttaggacggccagtcgacactccccgaccgtaggtttacaggtcggctagggtcggggtaccgtaggggacctaaggtaccttctaactttccctacaacccgtagtcccgacaacgtcccgttaaggacgtaccgtagtaaacgttattttggaactttaaggtttaattacgtagttaacaacgaggtacgtaagacgtacgacgggaacggtcccgtaccgggacggtaccggttaccggaccggaaaggggtaaccgaaagggttacgggaacgtacgaaagggtaacgtaaacgttgggtacgttaccgtacggaaccgttaccgttacttccgttcggttaccctttaacgtcctttacccggttccccgtaaccttaacggtttaaccg

SEQ ID NO: 441399 - DNA, 661 bp, Homo sapiens
  misc_feature: GZ8MTXP01B2DCI.11.57.F02.1.454.CMB.2.raw
  modified_base (207)..(207): a, c, t, g, unknown or other
  modified_base (536)..(536): a, c, t, g, unknown or other
  modified_base (612)..(612): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccaatgcgaggtgcaagtggncagtcgtgggggagtcttacggtcccgagggcccgggggggtccctggacgactctcctgtctagtctcgtggtattcgcctcgagtgactatcgccatggaaggtcgggtccccgccgagggcctaccgaagggggtaacgggggctagggaattgggtactttcgatactattacgctaggtagtggtgaaccacaattactaaccgtacgctagacctgtaggcggaacgggcccgtattacattcaacttctaccgagactacaaagtggaacccaaagtaaccttcgaaccttagttaacgtcctaaggaaaactccaaaccgnggttcccgaggaaggtaacggtacccggaagggttaccgaacggttcttagggtttaattattttaggttcgggtnaaccggggtacgacccccggttccccgttaaggggttccgtaacccggg

SEQ ID NO: 441400 - DNA, 633 bp, Homo sapiens
  misc_feature: GZ8MTXP01CH8JQ.11.57.F02.1.454.CMB.2.raw
  modified_base (204)..(204): a, c, t, g, unknown or other
  modified_base (214)..(214): a, c, t, g, unknown or other
  modified_base (263)..(263): a, c, t, g, unknown or other
  modified_base (291)..(291): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtcttcgtctcctggggaaacngtccaccctntcctgcagggccagtcaaaatattaacaactacttagcctggtaccaanagaaacctggccaggcctccaggctccncatctatgatgctatttaggacggccacgtggacactccccacctaggtttcagtggactaggtgggtcgtgggaccaggtacttctacttcctaaccacctaactcccgacacgtcctagacgtccctagaagttattttagacttagtttaacttacgttagtactaacgacgtcgttagcagccgaacggggtcccgtaccgggccgtaccggttccggacccgaacgggaaccgtaagggtaggaacgttacgaacggcggtaaacgtggttcggcttcggacctaccttacgttcttacgtcttactaacttccctcccgacctaacttcgttaacg

SEQ ID NO: 441401 - DNA, 615 bp, Homo sapiens
  misc_feature: GZ8MTXP01AN06P.11.57.F02.1.454.CMB.2.raw
  modified_base (264)..(264): a, c, t, g, unknown or other
  modified_base (285)..(285): a, c, t, g, unknown or other
  modified_base (289)..(289): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaacaactacttagcctggtccaanagaacctgccaggctccagcncctnatctatgatgactagtttagggacggccagtggcactccccaccgaggtttcaggtggactaggtgggtctcggggacagtacttcgatttccaccaaccatcccggcacgtccctaggcgtcctagaagttattttggacttagttttatacgttgtacaacgcgtacgtagcagacgtacggtcccgtaccgggacgtaccggttccggaccgaacggggaccgaagggtacgggaaacgttcgaaacggcgtaaacggttggtcgggctacggccttaccgattcgtcgtaccttcgtacctcccgttccctcttaacgttcg

SEQ ID NO: 441402 - DNA, 613 bp, Homo sapiens
  misc_feature: GZ8MTXP01BCC68.11.57.F02.1.454.CMB.2.raw
  modified_base (204)..(204): a, c, t, g, unknown or other
  modified_base (290)..(290): a, c, t, g, unknown or other
  modified_base (371)..(371): a, c, t, g, unknown or other
  modified_base (383)..(383): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtcaaaatattaacaactacttagcctggtaccaacagaaacctggccaggctccaggctctnatctatgatgctatttagggaggccagtggacactccccaccaggttcaggtgcagtgggtctgggacagtacttcattcncaaccatcccgnacgtcctagagcctagtaagtatttgattagtttattactagtacaacgtagcgtaagactagaccggacggtacccgttccgggaccggtaacggttccgggaccgaaaggggtaacccgaaggggtacggaagtaccgaaagaaccggaaagttggtacgggctcggcaaccgttcttccgtaaggtccttttcaaccgttcccttccccgtaaccgttaacgttccg

SEQ ID NO: 441403 - DNA, 629 bp, Homo sapiens
  misc_feature: GZ8MTXP01C4ZZY.11.57.F02.1.454.CMB.2.raw
  modified_base (186)..(186): a, c, t, g, unknown or other
  modified_base (585)..(585): a, c, t, g, unknown or other
tcagcgagagataccacgaccggtgctcgatttagctcgatatagttgggtttgggggcagggtttacacctgtggttctcggggctgccctttggctttggagatggttttctcgatggggggctgggagggcttttgttggagaccttgcacttgtactccttgccattcagccagtcctggtncaggacggtgaggacgctgaccacacggtacgtgctgttgtactgcctcctccgcggtctttgtctggctattatgccacctcccacgccgtcacgtacagttgaacttgacctcgagggttcttcgtggctcacgtccacaccacgcatgtcgaccctcgacgggggttcccccgtaggcgtccgaggggtaaggggctgggaactgggtaactttacgaattactaagttacgcgtaaggttaggtcgggttacgaccgtacctattaactacttaccggactaaggtacttcgtggtacggaacgggcctattcacgttcaagtttccaccgagaagacctaagtcggaactaaacaaccgtctaacgtaagttaacttcgtaagaaactcaaacngccttaggaacggtagccgaagggccacgggtcttaaggtttaa

SEQ ID NO: 441404 - DNA, 833 bp, Homo sapiens
  misc_feature: GZ8MTXP01BABP4.11.57.F02.1.454.CMB.2.raw
  modified_base (203)..(203): a, c, t, g, unknown or other
  modified_base (246)..(246): a, c, t, g, unknown or other
  modified_base (272)..(272): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacngtcaccctctcctgcagggccagtacaaatataacaactatanctgtcaacagaactgcagctccagcnctcatctatgatgctagtttaggagggccagtcggcactccccacctaggtttcaaggtggacaggtcggggtctcggggactaggtacctttcgacttcctaccaaccgtactccccgctacgtacccgttacgggacgtacccttaggtaaacgttagtttttacggtacctttaaagggtttttaacttttaaaccggtttacgtttaacccgaaaaccggtaacggtaaccggttaacgggtacgtaaaccgggcccggggtaaacccgggggttcccccggttacccccgggggtaacccggggtttaaccccggggtttccccgggggaaaacccccggggtaaaaccgggggaaaacccccggggtaaaaggggggttaccgggggttaaaaccgggttaaccggtaaaacggggaacccggttaaaccgggttcggggttaaaccggggaccgttccggaacccggttaaaccccttgttacccgtttcggttaccctttaaccgttaaccgttccccggttttacccccgaaccggtttctttaaccccggg

SEQ ID NO: 441405 - DNA, 558 bp, Homo sapiens
  misc_feature: GZ8MTXP01BV84K.11.57.F02.1.454.CMB.2.raw
  modified_base (203)..(203): a, c, t, g, unknown or other
  modified_base (370)..(370): a, c, t, g, unknown or other
  modified_base (372)..(372): a, c, t, g, unknown or other
  modified_base (526)..(526): a, c, t, g, unknown or other
  modified_base (550)..(550): a, c, t, g, unknown or other
  modified_base (555)..(555): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccacctgtctgcgtctccgtggggaaacngtccaccctctcctgcagggccagtacaaaatattaaacaactacttagcctaggttccaacagaaacctgccaggctcccaggctcctcatcatgatgcagtttaggaggcccagtggcactccccacctggttcagtgcaggtggtctgggacagcttcattacncnccatccgcaagcctagacgtcctagaatatttgctagtttattactgtacaacagcgtaagctagcgacggtccgtaccggcgtacggttccggaccgaaagggaccgaaggtggaaacgtcgaaagcgaacgttggtcgcgtcgacttaccgnttcgttgtccttcatccgttcccncgttntcg

SEQ ID NO: 441406 - DNA, 618 bp, Homo sapiens
  misc_feature: GZ8MTXP01BFWI9.11.57.F02.1.454.CMB.2.raw
  modified_base (263)..(263): a, c, t, g, unknown or other
  modified_base (281)..(281): a, c, t, g, unknown or other
  modified_base (283)..(283): a, c, t, g, unknown or other
  modified_base (289)..(289): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccacggagaaattgtgttgacacagtctccggccaccctgtctgcgtctccgtaggggaaacagtccaccctctcctgcagggccagtacaaaatataacaactactagcctgtaccaanagaactgcagctccagcncnatctangatgctagttaggacggccacgtgcctactccccaccgtaggttcaggttcgacgtaggtcgggtcgtacgggactacgtacttacattccaccaaccactcccgcgaacgcctaaggacgtcctagtaaattagtttcgactttaagtttacttacgtagtaacaaacgtagacgtacgacacgcggtacggtccgtccggacgtaccggtacggacgaaacgggaaccgtaaggtaggaacgtaacgaacggaacggtaacgttggtacgacgtacgacgaccgttacttacttcgttcttctacttccttacccgtccgttcgtcg

SEQ ID NO: 441407 - DNA, 595 bp, Homo sapiens
  misc_feature: GZ8MTXP01DLG20.11.57.F02.1.454.CMB.2.raw
  modified_base (492)..(492): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctatttagaggtgtccagtgcgaggtgcagtggtgcagtcgtgggggagtcttagtccgaggccggggggtcctgagactctctgtctagtctctggattcgccttcagtgactatcgacctagtggaaggtcgggtcccgccgaggcctaccggaggggtaagggggctagggaatggtatttcaatacattacgctagtagtggtgacgacaatatactacgcacgtctcgagtagacgggcctattcatctactctacgagacgaacaagtacgaaccaaacgtaacctactaactagtactacgtagaaactacaacncgaccgtagagaaggtacggaggacgacggtactagttaagtttatttagttggtacgcggtacggaccccggttacccccgttaagggttcgtaacccgggg

SEQ ID NO: 441408 - DNA, 615 bp, Homo sapiens
  misc_feature: GZ8MTXP01DNRMF.11.57.F02.1.454.CMB.2.raw
  modified_base (208)..(208): a, c, t, g, unknown or other
  modified_base (267)..(267): a, c, t, g, unknown or other
  modified_base (281)..(281): a, c, t, g, unknown or other
  modified_base (289)..(289): a, c, t, g, unknown or other
  modified_base (393)..(393): a, c, t, g, unknown or other
  modified_base (417)..(417): a, c, t, g, unknown or other
  modified_base (445)..(445): a, c, t, g, unknown or other
  modified_base (572)..(572): a, c, t, g, unknown or other
  modified_base (607)..(607): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcagggccagtacaaaatataaacaactacttagctgttaccaanagaacctgcaggcnccagctcnatctatgatgactagttagggcggccagtggacactcccaccgtaggtttcaggtggcaggtgggtctacgggactagtacttcagttcacaaccgtatcccgnacgacctaggactcgtagtaagtnttttgacttagtttatactcgtacaagngacgtagacacgcgggtaacggtcccgtccgggtacggtaccggttaccggaccgtaaacggggtaaccgaaggggtacggaagtcgaaggtaacgtaacgttgggtcgcgtacggaccttacgttnttaccgtgtttacttcacttcccgttcccgtaacncgtttccg

SEQ ID NO: 441409 - DNA, 733 bp, Homo sapiens
  misc_feature: GZ8MTXP01DLCI4.11.57.F02.1.454.CMB.2.raw
  modified_base (206)..(206): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccacctctcctgcagggccagtacaaaatattaaacaacttactagcctagttaccaacagaaacctggaccaggcctccgaggctcctcatctatgatgactagtttagggacggccagtcggacctacgtcccccaaccgtagggtttacaggttcggactagggtcggggtacgtacggggacctaaggtacctttacactttaccgtacccaaccgtacgtcccgacgtacgacccttaagggacgtacccgttagtaaacgtttagttttcgacgtttaaagttttaacttaacgttacgtaacgaaacgtacggttcgtaacgacgtaacggtacggggtaccgggtcccggttacccgggacggtaaccgggttaccggaaccgggtaaacggggtaaacccggaaagggttacgggaaacggttacgaaacgggtaacggtaacgttggtacggttcgtacgaccttaacttcgttcgttaacgtcttcgtaccttcccttacccgtcttaacgtcg

SEQ ID NO: 441410 - DNA, 616 bp, Homo sapiens
  misc_feature: GZ8MTXP01EGT06.11.57.F02.1.454.CMB.2.raw
  modified_base (209)..(209): a, c, t, g, unknown or other
  modified_base (289)..(289): a, c, t, g, unknown or other
  modified_base (293)..(293): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtncagtcgtgggggagtcttagtccgacgggtcccgggggggtccctgacgactctctgtctagtctcgtggtattcgcctnagtnactatgaccatgaaggtcgggtcccacaggcctaccgaagggtagggctaggaatggtatttcaatacattagcgtagttaggtggtcaacccgtaacaattaactacgtacgacagtactcgtagtaggaacgggtctattcactacaactcctacaagacaaacaagtagaaccaaacggtaactactatacgtaatacgtaaggaaactacaaactgaacctgaaggtaacgtacggacggtaccgttaggtactagttagttattacggtgtacggtaaccgaacggacccgttaccccggttaaggccgtaacccggg

SEQ ID NO: 441411 - DNA, 643 bp, Homo sapiens
  misc_feature: GZ8MTXP01AFT6B.11.57.F02.1.454.CMB.2.raw
  modified_base (219)..(219): a, c, t, g, unknown or other
  modified_base (260)..(260): a, c, t, g, unknown or other
  modified_base (280)..(280): a, c, t, g, unknown or other
  modified_base (282)..(282): a, c, t, g, unknown or other
  modified_base (348)..(348): a, c, t, g, unknown or other
  modified_base (362)..(362): a, c, t, g, unknown or other
  modified_base (368)..(368): a, c, t, g, unknown or other
  modified_base (374)..(374): a, c, t, g, unknown or other
  modified_base (381)..(381): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctccngcaggccagtacaaaatataacaactactagctgtaccaanagaacctgcaggctccagcncnatctatgatgactaagtttaggacgggccagtgacactccccaccgaggttcagtgcaggtggtcncgggacagtacttnattccncaaccntcccganacgcctagacgcctagaagttacttttgacttaagtttacttacgtacgtacaaacgtagcgtaagcgacggcggtaacgggcccgttaccgggaccggttaaccgggttacccgggaaccggaaacggggtaacccggtaaaggggttcgggaaacggtccgaaagggtaaccggtaaacgttgggtcggacccttaggacccaaccgttcttccgttcggttcttccgtaccttcccgtttaccccgcttaagttcccgg

SEQ ID NO: 441412 - DNA, 666 bp, Homo sapiens
  misc_feature: GZ8MTXP01A70F5.11.57.F02.1.454.CMB.2.raw
  modified_base (151)..(151): a, c, t, g, unknown or other
  modified_base (621)..(621): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccgganaaattgtgttgacacagtctccggccaccctgtctgcgtctccgtaggggaaacagtccaccctctcctgcagggccagtacaaaattattaacaactacttagccttaggttaccaaacacgaaacctggccaggcctcccaggcctcctactactctatgatgactagtttagggacgggccagttggacctaccgtccccaccgtaggtttcaggttgcgtagggtcggtcgtacggggactagtacttctactttaccaccaacctacgtccgacgtacgaccgtaggacgtacccgtagtaacgttactttcgaccttaaggttttaacttaccgttagtacctaacgagtaccgtacgacgtacggcgaacggtcccgaccgggtcggtaccgtcgggaccaagggtaccgaagggtacgaagtacgaaggcgtaaacgttggtcgttacgaccgcaaccgttnttccgttgtccttccggtctacccttccccgtaagttaacttcgg

SEQ ID NO: 441413 - DNA, 598 bp, Homo sapiens
  misc_feature: GZ8MTXP01DLCX7.11.57.F02.1.454.CMB.2.raw
  modified_base (240)..(240): a, c, t, g, unknown or other
  modified_base (334)..(334): a, c, t, g, unknown or other
  modified_base (350)..(350): a, c, t, g, unknown or other
  modified_base (591)..(591): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgactgcctcctcccgnggtctttgtcttggcattatgcacctccacgccgtcacgtaccagtgaacttgacctcagggtcttcgtgctcacgtccaccaccacgcatgtnacctcgagggggtccncgaggcctccccgagggtaagggctaggaatggatttcgaatacattagctaaggtagtggtacgcgaaccatagtactacgcaacgtactcgtagtcgaaacgggcctaatttccattcctaatacccgtaccgaaagacgactaaatcggaccaaacaaactcaacttaggttatccgttaaggaaacttcgaaacttgaccgttaaggacgtaacgtacggaaggaccgtaaccgggntttaagg

SEQ ID NO: 441414 - DNA, 659 bp, Homo sapiens
  misc_feature: GZ8MTXP01BI55Q.11.57.F02.1.454.CMB.2.raw
  modified_base (368)..(368): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcgttagtccgaggcccggggggtcctgagactctcctgtctagtctctggattcgcctcagtgactatgccagtgaaggtcgggtcccgccgaggcctaccgaagggtaacgggggctagggaatgggtattacatactatacgntagtagtggtcgaacgtaacctaatactaactacgacgtaacgtacttggtacggtaagggtaaccgggtaccttactactactacttacttacccgtacgaaacgaacgaaactaacggtacgaaacccaaacgtaacctactacgttacgttaacgttacgtaaacggtaaactaaccgaaacgtccgtaccgtaggaacggtaacggaacggaacggaccgttacggtataagttaattcgttagtaagtcggaacgacgtcccgttacccggtcgcggtaacccggg

SEQ ID NO: 441415 - DNA, 604 bp, Homo sapiens
  misc_feature: GZ8MTXP01EWKPK.11.57.F02.1.454.CMB.2.raw
  modified_base (241)..(241): a, c, t, g, unknown or other
  modified_base (255)..(255): a, c, t, g, unknown or other
  modified_base (259)..(260): a, c, t, g, unknown or other
  modified_base (265)..(265): a, c, t, g, unknown or other
  modified_base (272)..(272): a, c, t, g, unknown or other
  modified_base (289)..(289): a, c, t, g, unknown or other
  modified_base (307)..(307): a, c, t, g, unknown or other
  modified_base (317)..(318): a, c, t, g, unknown or other
  modified_base (381)..(381): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacgacggtacgtgctgttgtactgcctcctccgnggtctttgtcttgntatnnctccncacgccncacgtactagtcactcnctgtggtctgcgctcacnccaccacacnntgaccaccgtcggacggtccacgacgctaccggagggtagcgtagtagtgtacttcatacgtntagactagggtgtggcacgtacctaagtactaccgagtacgagtactggtaggaacgggaaccggtccttaattacgacttaccactaccgtaacgaagaacgaaactaggaccgaaacctaacctaccgtctaacgtttacgttacgtaaccgttaaagaaacttacgaaacgttcgttacgaaggaggaacggtacggacgttaccgtcggtttaattaag

SEQ ID NO: 441416 - DNA, 631 bp, Homo sapiens
  misc_feature: GZ8MTXP01B1967.11.57.F02.1.454.CMB.2.raw
  modified_base (263)..(263): a, c, t, g, unknown or other
  modified_base (381)..(381): a, c, t, g, unknown or other
  modified_base (387)..(387): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtcaaaatattaacaactacttagcctggttccaanagaaacctgccaggctcccaggctcctcatctatgatgctatttaggagggccacgtggcactccccacccgtaggtttcaggtggctaggtggggtctggggacagacttcattccncaaccnctcccgcacgaccctagacgtcctgtaagtattttgactagttttattacgtgtacaacgagcgtagacacggcgacgggtcccgtccgggaccggtacgttccgggaccgaacgggaccgtaagggtacgggaaacgttcgaaacggtcgtaaacgttgggtacggttccgtcgccttaaccgttcgttaccgtcggttacctttccgacgttccccgtttaccccgtaaccgttaacttccg

SEQ ID NO: 441417 - DNA, 572 bp, Homo sapiens
  misc_feature: GZ8MTXP01A2TMS.11.57.F02.1.454.CMB.2.raw
  modified_base (265)..(265): a, c, t, g, unknown or other
  modified_base (287)..(287): a, c, t, g, unknown or other
  modified_base (289)..(289): a, c, t, g, unknown or other
  modified_base (365)..(365): a, c, t, g, unknown or other
  modified_base (567)..(567): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaacttacttagcctggttccaanagaaacctggcaggctccagcncnatctatgatgctatttaggaggccatgcactccccaccagttcagtgcagtgggctcgggacagtacttcattccncaaccatccgcacgcctagacgccttagaatactttgactagtttattaactgtacaacgagcctaggcagcgacggccctaccgggcgaccggttccggaccgaaacgggacccgaagggttaggaaacgttacgaaaggcgtaaacgttggtacggctggaccacgttcttactgttctttccattcccttccgccgttnttccg

SEQ ID NO: 441418 - DNA, 665 bp, Homo sapiens
  misc_feature: GZ8MTXP01C56HC.11.57.F02.1.454.CMB.2.raw
  modified_base (204)..(204): a, c, t, g, unknown or other
  modified_base (290)..(290): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaaatataacaactacttagcctggttccaacagaaacctgccaggctcccaggctccnatctatgatgctagtttaggagggccacgtggccatccccaccctagggtttcaggtggcaggtgggtctggggacagtcttcattacctcaacccatcccgacacgaccctaggacgtccctagtaacgtattttagacttaagttttacttaacgttgtacaaacgagcgttaagcaggcggaacgggcccgttaccgggaccggtacggttaccggacccggaaagggtacccgaagggtgggaaacgtccgaaaggtccgaaacgttgggttacggccgttacggacccttaacccttagtttccccgtttggtaccctttttccgaaccgttttccccgtttaccccccgggtcccttaacgttttcccg

SEQ ID NO: 441419 - DNA, 543 bp, Homo sapiens
  misc_feature: GZ8MTXP01EF9KG.11.57.F02.1.454.CMB.2.raw
  modified_base (204)..(204): a, c, t, g, unknown or other
  modified_base (263)..(263): a, c, t, g, unknown or other
  modified_base (289)..(289): a, c, t, g, unknown or other
  modified_base (503)..(503): a, c, t, g, unknown or other
  modified_base (516)..(516): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactattagcctggttccaaanagaaacctggccaggctccaggctcncatctaatgatgctatttaggaggccatggcactccaccaggttcagtggcaggtggtactgggacagacgttcattcctcaaccatcccgcacgcctaggactccctagaagtattttgacttagtttattactgtacaacagctagacagcgacgcgtccgcgacgttcgacgaagggacgaagtggaagtcgaagaacgaacgttgtcggngtcgcgaccattntcgtctctactccttccgccaagttcc

SEQ ID NO: 441420 - DNA, 629 bp, Homo sapiens
  misc_feature: GZ8MTXP01DT7LD.11.57.F02.1.454.CMB.2.raw
  modified_base (205)..(205): a, c, t, g, unknown or other
  modified_base (261)..(261): a, c, t, g, unknown or other
  modified_base (273)..(273): a, c, t, g, unknown or other
  modified_base (279)..(279): a, c, t, g, unknown or other
  modified_base (281)..(281): a, c, t, g, unknown or other
  modified_base (596)..(596): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtaggggaaacngtccaccctctcctgcagggccagtacaaaatataacaactactagctgtaccaanagaactgcagcncgagcncnatctatgatgactagtttaggacggccagtggacactccccaaccgtaggtttcaggtgactggtcgggtctcgggactagtacttcactttccacaaccatcccgacacgtcctaaggcgtacttagtaagttattttacgactttaagttttaattacttacgtaacaaacgtggtaccgtagacgacggaccggtacggggtccccgtaccggggaccgtaaccgggttacccggaaccggaaacggggtaaccgaaggggtacggaacgtaccgaaaggtaaccgtaacgttggtacgcgtcgacacgttnttcgtctcttaacacttcccttaccgcttgtcg

SEQ ID NO: 441421 - DNA, 664 bp, Homo sapiens
  misc_feature: GZ8MTXP01CX3RU.11.57.F02.1.454.CMB.2.raw
  modified_base (259)..(259): a, c, t, g, unknown or other
  modified_base (277)..(277): a, c, t, g, unknown or other
  modified_base (279)..(279): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatataacaactatagctgtacaanagaactgcagctccagcncnatctatgatgactagtttaaggagggtccacgtggaccactccccacccgtagggtttcgaggtggctaggtggggtctaggggacagtacttcacttcctaccgaaccactcccggactaacgccgttaagacgtcctagtaacgtattttggacttaagttttaactaacgttcgttacaaacgtacgacgtacgacgtacgacggaccggtcccgtaccgggtacgtacggttccggaaccgaaagggggaacccgaaagggttacgggaaacgttacgaaacggtaacggtaaacgttacgggtacgggcctaggccttaacccgattccgttcggtactttccggtaaccttccgttacccccgtccgttaagtttcccg

SEQ ID NO: 441422 - DNA, 602 bp, Homo sapiens
  misc_feature: GZ8MTXP01EXB3Y.11.57.F02.1.454.CMB.2.raw
  modified_base (451)..(451): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaggtgtccagtgcgaggtgcaagtggtgcagtcgtgggggagtcttaggtccgaggcccggggggtcctgagactctcctgtctagtctctggattcgcctcagtgactatcgccagtggaagtcgggtcccgccgaggctccgaggggtaaggggctagggtaatgggtatttacgatacgtatttacgcgtaaggtagtggtacgaccgaacctaattaataccgtacgcaagacttcgtggtagaagggtccattcatcattctccaganacaagtcgacaacgaacttcacttagtactactaggaaacttacaaacgtacggtacctaggaagaacggtacggagtaaccgacgtcgttagttagttattacggttgtacgcgtaacggaccgttccccgtaagggttcgtaacccggg

SEQ ID NO: 441423 - DNA, 722 bp, Homo sapiens
  misc_feature: GZ8MTXP01B28YZ.11.57.F02.1.454.CMB.2.raw
  modified_base (205)..(205): a, c, t, g, unknown or other
  modified_base (288)..(288): a, c, t, g, unknown or other
  modified_base (298)..(298): a, c, t, g, unknown or other
  modified_base (381)..(381): a, c, t, g, unknown or other
  modified_base (383)..(383): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcagggcagtacaaaatattaacaactacttagcctggttccaacagaaacctggccaggctcccaggcncctcatctangatgactagtttaggacggccacgtcggcactccccgaccgtaggttcaggtggcaggtgggtctcgggacagtctcattccncnccagtcccgacacgcccttaaggacgtaccgttagtaacgttatttttacggactttaagttttaacgttaaccgttaggttaacccaaaacggacggttaccgaaggtacccgtacgggtacccgggacccggggtaccccggttaccccgggggtacggtaaacccgggtttcccgggggaaaccccggttaaacggggggaaccccgttaaagggggttaccgggaaaacggttaccgaaacgggtcggtaaaccggttgggtacggcgtacggacccttaccgttagttccgttaacgtcttccgtacttcccgttaccccgtcttaacgttccg

SEQ ID NO: 441424 - DNA, 567 bp, Homo sapiens
  misc_feature: GZ8MTXP01EZUOO.11.57.F02.1.454.CMB.2.raw
  modified_base (241)..(241): a, c, t, g, unknown or other
  modified_base (289)..(289): a, c, t, g, unknown or other
  modified_base (350)..(350): a, c, t, g, unknown or other
  modified_base (405)..(405): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacgacggtacgtgctgttgtactgcctcctcccgnggtctttgtcttggctattatgctacctccacgcctccacgtacagtnactgacctgaggtcttcgtgctcacgtccaccacacgcatgtcgaccctcgacggggtccncgacggctaccccgagggtaagggctaggaatggtattcatacattagctagtgngtcgcgacatactactacgacacgtactcgtaggtacgaagggaccgtattaccgattcgaacttcgaccgagacgtacaagtcgtacaaacactcaacttgttatacgttagaaactacaacgcgttcctaagagcgtacggaggacgtaacggcgttaag

SEQ ID NO: 441425 - DNA, 741 bp, Homo sapiens
  misc_feature: GZ8MTXP01CUCFM.11.57.F02.1.454.CMB.2.raw
  modified_base (151)..(151): a, c, t, g, unknown or other
  modified_base (205)..(205): a, c, t, g, unknown or other
  modified_base (261)..(261): a, c, t, g, unknown or other
  modified_base (281)..(281): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccgganaaattgtgttgacacagtctccggccaccctgtctgcgtctcctaggggaaacngtcaccctctcctgcagggccagtacaaaatactaacaactatagctagtaccaanagaacctgcaggctccagcnctcatctatgatgactagtttagggacgggtcacgtcggaccacgtaccccaccgtaggttacgacggtggcgtaggtcgggtcgtacggggactacggtacttctaactttcccaccaaccgtatcccgacgtacgtaccgttagacgaccttagggtaacttagttttacgattaacgttttaaacgttacgttacgtaacgaacgtacggtacgtaacgtacgacgtacggggaaccggggttcccggttaacccggggaccggttaaccgggttaccccggggaacccggaaacgggggtaaaccgggtaaacgggggtaacggtaaacggtaaccggaaacgggaacccggtaaaggttcggtacgggttaccgttacgacccggttaaaccgttcgttaccggttgttaacccttcgtacccgttcccgttaccccggtcccttaagtttcccg

SEQ ID NO: 441426 - DNA, 616 bp, Homo sapiens
  misc_feature: GZ8MTXP01AO0NE.11.57.F02.1.454.CMB.2.raw
  modified_base (205)..(205): a, c, t, g, unknown or other
  modified_base (258)..(258): a, c, t, g, unknown or other
  modified_base (264)..(264): a, c, t, g, unknown or other
  modified_base (274)..(274): a, c, t, g, unknown or other
  modified_base (277)..(277): a, c, t, g, unknown or other
  modified_base (279)..(280): a, c, t, g, unknown or other
  modified_base (606)..(606): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctccagataccaccggagaaattgtgttgacacagtctccggccaccctgtctgcgtctccgtaggggaaacngtccaccctctcctgcagggccagtacaaatataacactactagctgtccaanagaacngcagctccgngcncnntcatgatgctagtttaggacggccagtgcactccccaccgtagtcaggtgcgtaggtcgggtcgtacggggactagtacttctacttcctaccaaccactcccggactacggtaccgtaggacgtacctagtaagttcgtttgacttagttttacttactcgttaacaaagtcggtagtaacgcgaacgccggacggtcccgtccgggtaccggtacggtccggaaccgaaggggtaacccgtaaggggtacgaaacgtcgaaggaacgtaacgttgggtacgcgtacgaccttaccttagttcttgtcttcgaccttccgttccncttaagttcg

SEQ ID NO: 441427 - DNA, 661 bp, Homo sapiens
  misc_feature: GZ8MTXP01D59E9.11.57.F02.1.454.CMB.2.raw
  modified_base (205)..(205): a, c, t, g, unknown or other
  modified_base (292)..(292): a, c, t, g, unknown or other
  modified_base (475)..(475): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtccacctctcctgcagggccagtacaaaatattaaacaactacttagcctaggttaccaacagaaacctgccaggctcccagctcncatctatgatgctaagtttacggacggtccagtggcactccccgacctaggttcaggtggctaggtggtacctggggacctagtaccttcacttccctacgaaccagtcccgacacgtacccgtagacgtcctagtaagttagttttaggacttaagtttactttaacttacgttacaaacgngtacgtacgcacgcggtacggcccgtccgggacgtaaccggttcggaaccgtaacgggaccgtaaggtacggaacgtacgaacgggaactaacgttggtcgttacgtacggaccttaacggttctttacggtctttaccttaacctaccgttcccgtttaacccccgtaaccgttaacgttaaccg

SEQ ID NO: 441428 - DNA, 627 bp, Homo sapiens
  misc_feature: GZ8MTXP01DOVIS.11.57.F02.1.454.CMB.2.raw
  modified_base (267)..(267): a, c, t, g, unknown or other
  modified_base (289)..(289): a, c, t, g, unknown or other
  modified_base (291)..(291): a, c, t, g, unknown or other
  modified_base (392)..(392): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacagtccaccctctcctgcagggccagtacaaaatataaacaactacttagctaggttaccaanagaacctggcaggctccgagcncncatctatgatgctagtttagggcggccagtcgacactccccgactagggttcaaggtgcgtaggtcgggtctacgggacctagtacttctacttcctaccncgtactcccgacacgtaccgtagacgtctagtaagttatttcgacttagtttatactgtacaacgagtactagactaggcggtacgtccgtaccggaaccggtacggtacccggacgtaaaggaccgtaggtacgtaaacgtcgaaagggaacgtaacgttgggacggttctacggaccttacttacgttcgtaacgttcctaacgttaccgtcccttaccgtccgttaattcgg

SEQ ID NO: 441429 - DNA, 607 bp, Homo sapiens
  misc_feature: GZ8MTXP01EVLND.11.57.F02.1.454.CMB.2.raw
  modified_base (240)..(240): a, c, t, g, unknown or other
  modified_base (358)..(358): a, c, t, g, unknown or other
  modified_base (561)..(561): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgnggtctttgtcttggctattatcgccaaccctccacgccgtccacgtaccagtgaactgacctcagggtcttgtcgctcaccgtccaccaccacgcatgcgaccctcgacggggtcccncgaggcctccccgagggtagggctaggaatggactttcatactaattagacgtaggtaggtcggtgacgtaccaatataactacgacagtactcgtagtagaacgggtaccgtattacgaatactactacccgtacaacgaagaaccaaagtcggaacaaacctaactctaactaggttataccgttaaggaaactacgaacncgttccgtaaggagaacgtcggaacggacgtaaccggttgtttaag

SEQ ID NO: 441430 - DNA, 823 bp, Homo sapiens
  misc_feature: GZ8MTXP01BCTJF.11.57.F02.1.454.CMB.2.raw
  modified_base (265)..(265): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctaggttaccaanagaaacctggccaggctcccaggctcctcatctatgatgactagtttacggaggggtcccaacgttgggcctaactcccccgaaccccgtagggttttccaaggttcggactacggttgggggtaccgtcgggggaaccaggtacctttccaacgttttccctacccaacccgtaactccccgggactaacggtcccttaagggacgtaccccgttaggtaaacgttacttttttacggaaccgttaaggtttttaattaaccgttaggtttaaccaaacgtacggtaccgttaaacgccgtaacggaccggtaacggggtccccgttacccggggtacccggtaacccgggtttacccggggtaaccccgaaacgggggtaaaccccgtaaagggggttaccggggtaaacggttacccggaaaacggggtaaccggtaaacggtttacgggtaccgggttccgttaacgggtcccaaaccccgttacgtttaccgttcgtttacccggttaaccctaacgttccccgttttacccccggcccttaacgtttccccg

SEQ ID NO: 441431 - DNA, 652 bp, Homo sapiens
  misc_feature: GZ8MTXP01CMV2F.11.57.F02.1.454.CMB.2.raw
  modified_base (241)..(241): a, c, t, g, unknown or other
  modified_base (261)..(261): a, c, t, g, unknown or other
  modified_base (355)..(355): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctggggagggctttgttggagaccttgcacttgtactccttgccattcagccagtcctggtgcaggacggtgaggacgctgaccacacggtacgtgctgttgactgcctcctcccgnggtctttgtctggctattangccaccctccacgcccgtccacgtaccagtgaacttgacctcagggtctcgtgctcacgtccaccaccacgcatgcgacctcgacggggtcccncaggctcccgagggtagggctggatgggtatttcaatacattagcaggttagtggtcgacgtaccattaacgtacctacggactacggaaccttcgtaggttacggaacggggtcctaactttacggattacctaagttacccttaccgaaagaacggtaacctaaagtccggtaaaccaaacctaaccgttcaaacgttacggttaaactacgttaaaggtaaaactccgaaacgcggacccttaagggaacgtaacggtaccgggaagggttaacccgtaacggggtttgttaag

SEQ ID NO: 441432 - DNA, 787 bp, Homo sapiens
  misc_feature: GZ8MTXP01C26HR.11.57.F02.1.454.CMB.2.raw
  modified_base (204)..(204): a, c, t, g, unknown or other
  modified_base (214)..(214): a, c, t, g, unknown or other
  modified_base (259)..(259): a, c, t, g, unknown or other
  modified_base (281)..(281): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccacctcncctgcaggccagtacaaaatataacaactactagcctggtccaanagaacctgccagctccagctcncatctatgatgctagtttaggaggccacgtggaccactccccacccgtaggtttccaaggttcggactaggtcggggtacgtacggggaacctaggtaccttctaactttcccttacaacccaagttccccgacaaggtcccccttaaggacgtaccccttaggtaaacgttacgtttttacggaccgttaaagtttttaacgttaaccgtttacggttacctaaaacgaacgggtacgttaaacggtaccgaaacgttcccgggggaaaccgggttacccccggtttcccggggaacccgggttaaccgggtttaccccggggaacccggtaaaacgggggttaaaccccggaaagggggtaacgggtaaaacggttaccggaaaacggtcccgggtaaacgttggggttaccgggcgttacggaaccgttaacccgttacttacccgtttggttaccctttaactaccgtttcccgtttccccggtaaccgttaacctttcccg

SEQ ID NO: 441433 - DNA, 725 bp, Homo sapiens
  misc_feature: GZ8MTXP01AEU4E.11.57.F02.1.454.CMB.2.raw
  modified_base (205)..(205): a, c, t, g, unknown or other
  modified_base (259)..(259): a, c, t, g, unknown or other
  modified_base (279)..(279): a, c, t, g, unknown or other
  modified_base (281)..(281): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcagggccagtacaaaatataacaactactagctgtacaanagaacctgcaggctccagcncncatctatgatgctagtttagggacgggtccacgtcggaccactaccccgaccgtagggtttcaggtcggacgtagggtgggtacgtacggggactacggtacctttcgaactttccaccaaccctacgtcccggactacggtccgttaagggacgtaccctaggtaagtttacttttgaccttaaggtttttacttaacgttcgtaactaaacgacggtacgttaagccgtagggaccggacggggtccccggttccggggaccgttaaccgggttccgggaaccggtaaaccgggggtaaccgtaaggggtaacgggtaaacgtaaccggaacgggtaacggtaaaccgttgggtacggttaccgtacggacccttaaccttgttaccgttcggttaccttaacctacccgttcccgttaccccgtaacttaacggtttcccg

SEQ ID NO: 441434 - DNA, 763 bp, Homo sapiens
  misc_feature: GZ8MTXP01E3BY6.11.57.F02.1.454.CMB.2.raw
  modified_base (206)..(206): a, c, t, g, unknown or other
  modified_base (265)..(265): a, c, t, g, unknown or other
  modified_base (415)..(415): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccacctctcctgcagggccagtacaaaatattaaacaactacttagcctgtaccaanagaaacctggaccaggcctcccaggcctcctacatctatgatgtctagtttagggcgggccaacgtggaccaaccttcccccaacccgtaagggtttccagggttcggacctagggtcgggggttactacgggggaccaggtacctttanactttacccaccaacctactcccgacacggtccctaagggacgtcccgtagtaaagttactttttaggacttaagttttaacttaccgttacggtacctaaacgtacggacgttaacggacgacggaccgggtaacgggtccccggtacccggggtacccggtaaccggggtttacccgggaacccgggaaaacgggggtaccccggaaaggggttacgggaaacggtaaccgaaacggggtaaccgtaaacggttgggtaacggcgttaccgaccgttacccgttagttccgtcggtttccttaaccttacgttccccgttaccccggtaaccttaacgttaacccg

SEQ ID NO: 441435 - DNA, 735 bp, Homo sapiens
  misc_feature: GZ8MTXP01BW2XM.11.57.F02.1.454.CMB.2.raw
  modified_base (205)..(205): a, c, t, g, unknown or other
  modified_base (257)..(257): a, c, t, g, unknown or other
  modified_base (263)..(263): a, c, t, g, unknown or other
  modified_base (269)..(269): a, c, t, g, unknown or other
  modified_base (272)..(272): a, c, t, g, unknown or other
  modified_base (275)..(275): a, c, t, g, unknown or other
  modified_base (278)..(278): a, c, t, g, unknown or other
  modified_base (393)..(393): a, c, t, g, unknown or other
  modified_base (403)..(403): a, c, t, g, unknown or other
  modified_base (413)..(413): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtcaccctctcctgcagggccagtacaaatataacactactagctgtacaanagaacngcagcnccngcnctnatctatgactgctagtttagggacggccacgtggaccactccccgaccgtagggtttccaggttcggctagggttcggggtcgtacggggaactaggtaactttcactttacccnctaacccgtntccccggganacgtccgtaaggacgtacttaagtaagtttagtttacgtactttaagttttacttacgtacgtactaaacgacggtacgtaacgacgacggtaccgggtaccgggtacccggtacccgggtaccgggtacccgggttaccggggaaaccggtaaaccgggggtaaccggtaaagggggtacgggtaaacggtaccggaaacgggtaaccggttaacgggttcggtcggggttaccgtaccggtaacccgttaccgttacgttccgtttaacgtttcccgtttaaccgtacccgttcccgttaccccgtccgttaacgttcgg

SEQ ID NO: 441436 - DNA, 727 bp, Homo sapiens
  misc_feature: GZ8MTXP01AUHSV.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtggggaaacagtccaccctctcctgcagggccagtacaaaatataacaactacttagcctggttaccaacagaaacctggccaggcctcccaggctcctcatctaatgatgctagtttagggacgggtccagtcggaccactcccccaccgtacgggtttcaacggttggccgtaggttggggtaccgtaggggacctaggtactttactattaccctaccaacctacgtcccgactacgtccctaagggacgtacccttaaggtaaaggtttacttttgggaactttaaggttttaactttaacgttggttaacaactacggtaccgttaagcaacggcggaacgggtccccgtaccgggaccgtaccgggttccgggaccgtaaacggggacccgtaaaggggtacggaaacgttaccgaaagggtaacgtaaacggttcggtacgggccttcggaaccttaccgttacttcccgtttaaggtcctttccgaactttccccgttaccccggtaacttaacgttaaccgg

SEQ ID NO: 441437 - DNA, 598 bp, Homo sapiens
  misc_feature: GZ8MTXP01EPNZM.11.57.F02.1.454.CMB.2.raw
  modified_base (207)..(207): a, c, t, g, unknown or other
  modified_base (277)..(277): a, c, t, g, unknown or other
  modified_base (279)..(280): a, c, t, g, unknown or other
  modified_base (286)..(286): a, c, t, g, unknown or other
  modified_base (320)..(320): a, c, t, g, unknown or other
  modified_base (364)..(364): a, c, t, g, unknown or other
  modified_base (404)..(404): a, c, t, g, unknown or other
  modified_base (558)..(558): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctgcctcccagataccaccggagaaattgtgttgacacagtctccggccaccctgtctgcgtctccgtaggggaaacngtcaccctctcctgcaggccagtacaaatataacaactactagctgtacaacagaactgcagctccagcncnntctatnatgactagttaggcggcacgtgcactccccacgnggtcagtggactaggtggtctacgggactagactttcacttacnccaactactccgacacgtccgtaagcgtccctagtaaatntttcgacttaagtttattacgtacgttaacagtacgtcgtaacgcgacggaccgggtacggaccccgtccgggtaccgtacggtccggaccgtaaagggaaccgaagggtacgagtacgaacgtaacgtaagttggtcgcgtacggcaacgttnttcgtcgtacttccagtccccgttactccggttaatttcg

SEQ ID NO: 441438 - DNA, 821 bp, Homo sapiens
  misc_feature: GZ8MTXP01AW2B1.11.57.F02.1.454.CMB.2.raw
  modified_base (262)..(262): a, c, t, g, unknown or other
  modified_base (284)..(284): a, c, t, g, unknown or other
  modified_base (286)..(286): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtaggggaaaccagtccaccctctcctgcaggccagtacaaaatataacaactactagctgtaccaanacgaacctgccaggctccagcncnatcatgatgacgttagtttacgggacgggcctacgtacggaccctactacccccgtaaccggtagggtttcccgaagggttcggacggtaggttcggggtcgttaccgggggactacggtactttctactttacccaacctaacccgtacgtacccggacgtaacgtcccgtaacgggtacgtacccgttaagttaaacgttttacgtttttacggtaaccttttaaacggtttttaactttaacgttacgggtttaaaccaaaccggttaacggaaccggttaaacgacccggtaaacggtccggggaaacccggggtcccccggttacccggggtaacccgggttaaccggggttaccccgggtaaaccgggaaacccggggtaaccggtaaacgggggttaacgggaaacggttaaccgaaacgggtaaccggtaaaggttccgggtacggaccttcggaaccgttacgttaccgttccgttcggttaaccttcctaaccgtttcccccttacccggccttaacgtttccgg

SEQ ID NO: 441439 - DNA, 577 bp, Homo sapiens
  misc_feature: GZ8MTXP01BOJ62.11.57.F02.1.454.CMB.2.raw
  modified_base (241)..(241): a, c, t, g, unknown or other
  modified_base (325)..(325): a, c, t, g, unknown or other
  modified_base (350)..(350): a, c, t, g, unknown or other
  modified_base (447)..(447): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacgacggtacgtgctgttgtactgcctcctccgnggtctttgtcttggctattatgcaccctccacgccgtccacgtaccagtgactgactcgaggtctcgtgctcacgtccaccacncgcatcgtcgacctcgacgggtccnccgaggcctcccgagggtagggctggtaactgggatttcgatacgtattagacgtaggtagtggtcgacgtaaccataactactagacagacttcgnggtacgaacgggccgtatcgactcactcacagactacgaagtcgacaactacacgtaactattctacgttaagtaaactacaacgacgttaccgtaaggacgtaacgacggagaccggtcgttcgttaag

SEQ ID NO: 441440 - DNA, 579 bp, Homo sapiens
  misc_feature: GZ8MTXP01A7L1F.11.57.F02.1.454.CMB.2.raw
  modified_base (317)..(317): a, c, t, g, unknown or other
  modified_base (420)..(420): a, c, t, g, unknown or other
  modified_base (538)..(538): a, c, t, g, unknown or other
  modified_base (574)..(574): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggcgtttgttggagaccttgcacttgtactccttgccattcagccagtcctggtgcaggacggtgaggacgctgaccacacggtacgtgctgttgtactgctcctcccgcggtcttttgtcttggctattatgcaaccctccacgcccgtccacgtaccagtgaactcgacctcgagggtcttcgngctcacgtccaccaccacgcatgtcgacctcgacgggtcccgaccacggctccccgaggtaggggctaggaatcgggatttcaatactatacgcagtagtggngacgacatacgtactacgcagactctaggagaacggtaccgattacgatctatcctaccaggacaacaagtgaccaaacaccttcgaactggttatacgttaaggaaacttcgaaacngccgtaagacgggtaagcggacggactaaccggttnttaag

SEQ ID NO: 441441 - DNA, 721 bp, Homo sapiens
  misc_feature: GZ8MTXP01BBOHA.11.57.F02.1.454.CMB.2.raw
  modified_base (237)..(237): a, c, t, g, unknown or other
  modified_base (262)..(262): a, c, t, g, unknown or other
  modified_base (282)..(282): a, c, t, g, unknown or other
  modified_base (284)..(284): a, c, t, g, unknown or other
  modified_base (408)..(408): a, c, t, g, unknown or other
  modified_base (442)..(442): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtacaaaatntaaacaactacttagcctgtccaanagaacctgcaggctccagcncncatctatgatgctagtttaggacggccacgtcggcactaccccgaccgtaggtttcaggtggactaggttcggggtctacggggactagtacctttcaattccctaccaaccctatcccggacncggtaccgtaggacgtcccgtaaggtaaacgttnttttagaccttaggttttaattaaccgtggttaaccaaacgtagaaccgttaggacctaaggacggtaaccgggtccccgttacccggggaccgttaacccgggttcggggaaccgaaacgggggaaaccctaagggggttaacggaaacgttcccggaaaggtccccggtaaaggtttcgggccgggttacgtaccgggttaacccaaaccggttcttacgttcggttacccttaacgtacccgttcccgtttacccccggaaccttaacgtttccgg

SEQ ID NO: 441442 - DNA, 740 bp, Homo sapiens
  misc_feature: GZ8MTXP01BVFTX.11.57.F02.1.454.CMB.2.raw
  modified_base (205)..(205): a, c, t, g, unknown or other
  modified_base (267)..(267): a, c, t, g, unknown or other
  modified_base (290)..(290): a, c, t, g, unknown or other
  modified_base (294)..(294): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtccaccctctcctgcagggccagtacaaaatattaaacaactacttagcctggttaccaanagaacctggcaggctcccaggcncctnatctatgatgctagtttaggacgggcctacgtggacacgtcccctacccgaggtttcaggtcggctaggtgggtcgtacggggactaggtacttcgactttaccgtctaaccgactcccgcacgtaccgtaaggacgtccttaggtaacgttagtttttacgacgtttaaggttttaactttaacgttacgttacaaacgtacggtaccgtaacgtacgaacggtaccggaacggggtccccgttaccggggtaccggtaacccgggtttaccggggaacccgtaaacgggggaaacccggtaaaggggtacgggtaaacgttaccggaaacggaaccgtaaacggttcggttacgggcgttacggacccttaccgttacgtttcgttcggtttccgtttcccttaacgtttccccgttaccccggtaacccttcgtttaacccgg

SEQ ID NO: 441443 - DNA, 619 bp, Homo sapiens
  misc_feature: GZ8MTXP01CCVJ5.11.57.F02.1.454.CMB.2.raw
  modified_base (204)..(204): a, c, t, g, unknown or other
  modified_base (266)..(266): a, c, t, g, unknown or other
  modified_base (287)..(287): a, c, t, g, unknown or other
  modified_base (290)..(290): a, c, t, g, unknown or other
  modified_base (308)..(308): a, c, t, g, unknown or other
  modified_base (381)..(381): a, c, t, g, unknown or other
  modified_base (388)..(388): a, c, t, g, unknown or other
  modified_base (401)..(401): a, c, t, g, unknown or other
  modified_base (587)..(587): a, c, t, g, unknown or other
  modified_base (594)..(594): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaacttacttagcctggttaccaanagaaacctgcaggctccagcnctnatcatgatgcatttaggnggaccacgtggcatccccacctaggtttcagtggcaggtgggtctcgggacaggtacttcgattcctcaaccntcccganacgccgtaagacnccgtagaaagtattttggacttaaggttttacttacgtagttacaaacgtagtacgttaaggcctaaggacggaacggtcccgtaccgggtccggtaacgttcccggaaccgtaaacggggaacccgaaagggtcgggaaacgtccgaaagggtcaaacgttggtcggacgttggacaacccgttnttccgtntcttctacttccttccctcttgtcg

SEQ ID NO: 441444 - DNA, 609 bp, Homo sapiens
  misc_feature: GZ8MTXP01BCM97.11.57.F02.1.454.CMB.2.raw
  modified_base (283)..(283): a, c, t, g, unknown or other
  modified_base (353)..(353): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcttaggtccgagggcccggggggtcctgacgctctcctgtctagtctctggattcgcctnagtgactatgccatggaagtcgggtcccgccgaggctccgaagggtaacgggggctaggaatggtatttnatacattacgctagtgtggtcgacgaccaagtactacctacgcaagtactcgtaggtaggaaacgggtccgaatttcgaactccaactcctaccaagaacgaacaagtacggaccaaacgtactcacttagtactcgtaacggaaactacaaacgcgtacctaggaagaacggtacggacgggaccacgggtcttagttattatttacgtaagtgaacgacgacccgttaccccgtaacgggttcgtaacccgggg

SEQ ID NO: 441445 - DNA, 733 bp, Homo sapiens
  misc_feature: GZ8MTXP01AIEPV.11.57.F02.1.454.CMB.2.raw
  modified_base (207)..(207): a, c, t, g, unknown or other
  modified_base (292)..(292): a, c, t, g, unknown or other
  modified_base (304)..(304): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcgagggccagtacaaaatataaacaactactagcctagtacaacagaacctgaccacggcctccgagtcnctcatctatgangtactagttagggacggccacgtcggctactccccgaccgtaggttcgaggtcggacgtaggtcgggtcgtacgggactagtactttaccactttacccaccgtaaccaccgtcccggacgtaccgacccggttaagacccgtaccgtaaggttaaagtttacgtttcggactttaacggttttaattacccgtaggttaaaccaacgtacggtacgttaacgcgtacggaccggttaccggggcccgttacccggggaccggttaccggggttaccgggaaacccgaaacgggggtaaccgtaaaggggttaccggggaaactaaccgggaagtaacccggtaaagttcgggtacggttccgtactaacccgacccttgttacccgtgttaccctctaccgttcccggttcccaacgttaactccggg

SEQ ID NO: 441446 - DNA, 549 bp, Homo sapiens
  misc_feature: GZ8MTXP01ADZIK.11.57.F02.1.454.CMB.2.raw
  modified_base (360)..(360): a, c, t, g, unknown or other
  modified_base (459)..(459): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtccctgagactctcctgtctagtctctggattcgcctcagtgactatgccatgagtggtccgcaggctcgaggtagggctggaatggatttcatacattacgcagtagtggtgacgacntactactacgcagactctgtagaacggccgtattcatcatctccagacgacaagtcgacaaacgaactcaacttggtaactcgtagaaacttccaaacngcctagagtaaggtcgaaggtacacgggtactggttattagttattggtagaaccgtaaacgccccgttaagggtcgaaccggtcccggg

SEQ ID NO: 441447 - DNA, 662 bp, Homo sapiens
  misc_feature: GZ8MTXP01AEUP7.11.57.F02.1.454.CMB.2.raw
tcagcgagagataccacgaccggtgctcgatttagctcgatatagttggggtttgggggctctcagagaggtgccttggtcctggattccaaggcatttccacttggtgatcagcactgaacacagaggactcaccatggagttggggctgtgcgttgggttttccttgttgcttattttagaaggtgtccagtgcggaggtgcgaaggtggtgcaggtcggtgggggagtcgttacggtccgacgggcccgggggggtcctgagactctcctgtctagtctctggattcgcctcagtgactatcgccagtgaaggtcgggtcccgccaggcctccggaagggtaggggctagggaactggtatttacgatactattacgactaggtagtggtcgacgaacctaagtactactacgacagtactcgtaggtaggaacgggcctatacatactactctaccagacgaacaagtcggaaccaaacctaactactaccttaaggtactaccgtaggaaaacttacccaaactacggtaccctaggaagtaaccggtacggaacggtacgacggacgtttaagttaattaagttttagttaacggtacggaacccggtaacggtacccggttaccccccggttaacgggttccggttaaccccggg

SEQ ID NO: 441448 - DNA, 731 bp, Homo sapiens
  misc_feature: GZ8MTXP01AF8U6.11.57.F02.1.454.CMB.2.raw
  modified_base (205)..(205): a, c, t, g, unknown or other
  modified_base (690)..(690): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccaccctctcctgcagggccagtacaaaatattaaacaacttacttagccttaggttaccaaacaacgaaacctgggaccacgggtcctcccgaggtccctcctacacttctagtcgaatggacttaagtttacggggacgggtcctacgtcggacctaccttacccccgaccgtagggtttccaagggttcggaagtcggggttcgggtcgtaccgggggaactacggtactttaccactttcccacctaacccgtgtccccggacgtaaccgtacccgttaaggaccgttccgtaaggttaagtttaacgttttcgaacgtttaaggttttaactacgttcggtaaacctaaacgtacgggaccgtagaccgacggaccgggtaccgggttcccgcgggtaacccgggtacgttaccgggacgaacggggtacgaggtacgacgtacgaaggtcgaacgttcggagctacgccttacgttnttaccctggtacttcgcttcccgttccaaccgttaattccg

SEQ ID NO: 441449 - DNA, 575 bp, Homo sapiens
  misc_feature: GZ8MTXP01BRQC4.11.57.F02.1.454.CMB.2.raw
  modified_base (489)..(489): a, c, t, g, unknown or other
  modified_base (536)..(536): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgcttatttagaggtgtccagtgcgaggtgcaagtggtgcagtcgtgggggagcgttagtccgagggcccggggggtccctgacgactctcctgtctagtctctggattcgcttcagtgactatcgacctagtggaaggtcgggtccccgccgagggtcctaccggaagggggtaacggggctagggaatggtactttacgataactagttacgacgtagtaggtggtcgaccgaacctaatactacctacgcaagtactcgtgtaggaacggaccgtatcatcaatcctacaagactacaagtgaccaacactacatgtancgtagaactcgaactgctaggagaagtcgagacgagtctgttaattnttagttgacgcggacgcccgcccgtaagggcgtaaccgg

SEQ ID NO: 441450 - DNA, 705 bp, Homo sapiens
  misc_feature: GZ8MTXP01CUBPQ.11.57.F02.1.454.CMB.2.raw
  modified_base (151)..(151): a, c, t, g, unknown or other
  modified_base (205)..(205): a, c, t, g, unknown or other
  modified_base (270)..(270): a, c, t, g, unknown or other
  modified_base (296)..(296): a, c, t, g, unknown or other
  modified_base (323)..(323): a, c, t, g, unknown or other
tcagcgagagataccacgaccggtgctcgatttagctcgatataggttgggtttgggggaggaactgctcagttaggacccagagggaaccatggaagccccagctcagcttctcttcctcctgctactctggctcccagataccacgganaaattgtgttgacacagtctccggccaccctgtctgcgtctcgtaggggaaacngtccaccctctcctgcgagggtccagtaacaaaatattaaacaactacttagccttggtaccaanagaaacctggcaggctccgagctctnatctatgatgctagttaggcggctagnggaccacgtccccacgtaggtttcaggtggtacgtagggtcggtcgtacgggacctagtacctttacgtaacttccctacaaccctcgtacccgacgtacgtacccgtaagaccggttctaagtaaagttcgttttacgaactttaggtttaactacgttaacgtaacaaacgtaggtacgtagaacgtacggaccggtacgggtccccggtaccgggacgggtaacccggttacgggaacccggtaaggggaaaccgtaagggtacggtaaacgtacggaaacgggtcgtaaacggttggtacggacgttacgccttaaacgttcgttacgttaacgtaccctttcggtacctcccggttaccctaacgttaacgtttccg

SEQ ID NO: 441451 - DNA, 655 bp, Homo sapiens
  misc_feature: GZ8MTXP01ADTBR.11.57.F02.1.454.CMB.2.raw
  modified_base (254)..(254): a, c, t, g, unknown or other
  modified_base (264)..(264): a, c, t, g, unknown or other
  modified_base (284)..(284): a, c, t, g, unknown or other
  modified_base (287)..(287): a, c, t, g, unknown or other
  modified_base (485)..(485): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcaggccagtacaaaatattaaacaactacttanctgtaccaanagaacctggcagctccagcnctnatctatgatgtactaagtttacgggacggtccacgtcggactaccgtaccccaccgtagggttcgaggttcggacgtagggttcgggtcgtacgggactaggtaccttctactttaccacaaccctacgtcccggacaacgtccgtaaggactaccgtagtaagttactttgacttaagtttatactaggtacaacgngtcgtacacgacgacggacgggtccccgtccgggaccgtaaccgggttccggaccggtaaacgggaacccgtaagggtacggaaagtaccggagtaaccggtaaggttggtcggacgtcggacaccgttattcgtccgttactctaccgtccttacccgtcaacgttccg

SEQ ID NO: 441452 - DNA, 739 bp, Homo sapiens
  misc_feature: GZ8MTXP01APRM4.11.57.F02.1.454.CMB.2.raw
  modified_base (206)..(206): a, c, t, g, unknown or other
  modified_base (255)..(255): a, c, t, g, unknown or other
  modified_base (257)..(257): a, c, t, g, unknown or other
  modified_base (261)..(261): a, c, t, g, unknown or other
  modified_base (264)..(264): a, c, t, g, unknown or other
  modified_base (270)..(270): a, c, t, g, unknown or other
  modified_base (273)..(273): a, c, t, g, unknown or other
  modified_base (275)..(275): a, c, t, g, unknown or other
  modified_base (281)..(282): a, c, t, g, unknown or other
  modified_base (294)..(294): a, c, t, g, unknown or other
  modified_base (300)..(300): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtaggggaaacngtccaccctctcctgcaggccagtacaaatataacactatgctgtcaananaacngcngctccngcncnatcatnntgctagttaggnggcacngcactcccaccgtaggttcaggtggctaggtcgggtcgtcggggaactaggtaccttcgtatttcccaccaacctacgtcccgaccacgtccttaaggacgtcctagtaacgttagttttcgactttaaggttttacttaccgttaggtaccctaaacgtacgggtacgttaacggtacgaacggaccggggtaaccggggttcccccgggttaccggggacccgggttaacccggggtttacccggggacccggtaaaaccgggggtaacccggtaaagggggtaccgggtaaaacggttaccggaaacgggtaaccgggtaaacggttgggtaccgggttaccgttcgggcccttaaacccgttcgtttccgttaaccggttcctttaacccgtccgtttaccccgttccccgggtaaccttaaccgttttcccggg

SEQ ID NO: 441453 - DNA, 679 bp, Homo sapiens
  misc_feature: GZ8MTXP01BX6ZM.11.57.F02.1.454.CMB.2.raw
  modified_base (202)..(202): a, c, t, g, unknown or other
  modified_base (266)..(266): a, c, t, g, unknown or other
  modified_base (281)..(281): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccacggagaaattgtgttgacacagtctccggccacctgtctgcgtctccgtggggaaacngtcaccctctcctgcaggccagtacaaatataacaactactagctgtacaacagaactgcagcnccagctctcatctangatgactagtttaggacgggaccacgtcggactacgtacccccaccgtagggtttcaggtggctaaggtgggtctcggggactaggacttcatttacctcaacctacgtcccgacaacgcccttaaggacgtccctaggtaaacgttattttgaccttaagtttttaacttacgtaggttaccaaacgtagacgttaacgacacggcgaacggggtcccgtaccgggacggtaaccggtttccggacccggaaacggggtaaccccgaaaggggtcggtaaacggtcgtaaacggcggtaaaccgttgggttacgcgttacggccttaaaccgttacttcccgtttgttacccgttccttaacgtttcccgtttaccccggttaacttaacgttccgg

SEQ ID NO: 441454 - DNA, 799 bp, Homo sapiens
  misc_feature: GZ8MTXP01DHIVP.11.57.F02.1.454.CMB.2.raw
  modified_base (208)..(208): a, c, t, g, unknown or other
  modified_base (272)..(272): a, c, t, g, unknown or other
  modified_base (297)..(297): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcgagggccaagtacaaaatattaaacaacttacttacgctgttaccaanacgaacctgcaggctccagctcctnatctatgatgtactagtttaagggcgggaccacgtcggcctaacctcccccgacccgtagggtttcgaaggtcggaccgtaggggtcggggttccgtacgggggaacctaacggtacctttacctactttaccccgttaccaaccccgtaacgtcccccgggactaacccggtaccccgtaagggtaccgtacccgtttaagggttaaacgttttacgtttttgggaaccttttaaagggttttttaaactaaccgtttacgttaaccgaaaccggtacggtacgtacggacgaaccgggccggtaacccggggtccccggttacccgggaccgggttaacccgggttaccgggaacccggttaaacgggggaacccggtaaaggggttaacgggaacgtaacggtaaccgggtaaccggtaacgttcgggtcggaacgtccgtaccacgttacttcgttccgttacttccgtaccttcccttacccgtcttaacgttaacg

SEQ ID NO: 441455 - DNA, 664 bp, Homo sapiens
  misc_feature: GZ8MTXP01AFU1T.11.57.F02.1.454.CMB.2.raw
  modified_base (235)..(235): a, c, t, g, unknown or other
  modified_base (371)..(371): a, c, t, g, unknown or other
  modified_base (383)..(383): a, c, t, g, unknown or other
  modified_base (385)..(385): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatnttaaacaactacttagcctggttccaacagaaacctggaccaggctcccaggctcctcatctatgatgctatttagggacgggccacgtggcacgtccccacccgaggtttccaggtggcaggtggtctggggacngtacttcattcncnccatccgacacggccttaggactcctacgtaagtattttacggcttaaggtttatttacccgtgtacctaaacgcgtacgttacggctaggaccgaggcccgttccgggacggtaccgttcgggaccgaaacgggggtaccaaaggggttcggaaacggttaaccgaagggtaaccgaaacgttcgggttacgggacccgttgggacccttacccgttaagttcccgttcgttcctttaacaccgtttcccgttacccgtccccgttaattaaccccgg

SEQ ID NO: 441456 - DNA, 602 bp, Homo sapiens
  misc_feature: GZ8MTXP01A1MJD.11.57.F02.1.454.CMB.2.raw
  modified_base (244)..(244): a, c, t, g, unknown or other
  modified_base (266)..(266): a, c, t, g, unknown or other
  modified_base (379)..(379): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctggggagggctttgttggagaccttgcacttgtactccttgccattcagccagtcctggtgcaggacggtgaggacgctgaccacgacggtacgtgcttgttgtactgcctcctcccgnggtcttttgtcttggctattancgccaccctccacgcccgtccacgtaccagtcgaacttcgacctcgagggttcttcggtggcctcaccgtcccaccaccacgctagtcggtcgaccgtcggacgggggtcccncgaggcctacccggagggtagggctaggaatggatttcatacattagctaggtgtcgtgacgactatactactacgacacgtactcgtagacggaacggcgtattcgactcgactctaccagacgacaagtcgacaactactcaatagttactacgttagtaaactacaacgttcgaccgtaaggaacggtcggtacggacggaccgtaacggttcgttaagg

SEQ ID NO: 441457 - DNA, 775 bp, Homo sapiens
  misc_feature: GZ8MTXP01AYQL8.11.57.F02.1.454.CMB.2.raw
  modified_base (268)..(268): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccacctctcctgcagggccagtacaaaattataaactaactacttagcctaggttaccaanacgaaacctgggaccaggcctcccgaggcctcctacatctagtgactgactagtttagggcggacctagtcggccactaccccgaccgtaggtttccgaggtcggcgtagggttcggggtacgtacggggactaggtaccgttactacttaccctacaaccgtaccgtcccgacgttaacgcccttaaagggacgtcccgttaagggtaattacggttttacgacctttaaaggttttattaacccgttagttaacgaaccgtaggtacccgttagacccgaacgtcggggtaaccggggtccccgttaccggggaccgggttaaccggttacccgggaaccggtaaacggggacccggtaaagggggtaccgttaaacggacccggttaaaggaacggtaacccggttagggtccgggttccgtaacgtaccccgaacgttcttaccgggttccgttacctttcccaccgtttaaccccggttcccgttaacttcggtttaaccgg

SEQ ID NO: 441458 - DNA, 772 bp, Homo sapiens
  misc_feature: GZ8MTXP01AV2RD.11.57.F02.1.454.CMB.2.raw
  modified_base (205)..(205): a, c, t, g, unknown or other
  modified_base (300)..(300): a, c, t, g, unknown or other
tcagcgagagataccacgaccggtgctcgatttagctcgatatagttggggtttgggggaggaactgctcagttaggacccagagggaaccatggaagccccagctaagcttctcttcctcctgctacactggctcccagataccacggagaaattgtgttgacacagtctccggccaccctgtctgcgtctccgtagggaaacngtccaccctctcctgcagggccaagtacaaaattattaaacaacttactacgcctaggttaccaacagaacctggaccaggcctccgagcctccncatctatgatgactagttagggacggcctacgtaggcctaccgtaccccgaccgtaggtttacaggtggccgtaggtcggggtcgtacggggactacggtacttacgactttccaacctacctaagtccccgactaaccggcctaggacgtacgtaggtaacttttacgtttgacgtttaagttttacttacgtaacgttaccaacggtaacggtacggtaacgaccgtacgggaccgtaaccgggggtcccgttaccccggggtacgggaaccccggtttacccgggaacccggtaaacggggtaaccggttaaaggggaccgggtaaacgtaccggaaacggtaccgggtaaacgttcgggttacgggccttaaaccggacctaaacccggtttcgtttccgttaccgtttaaccgttcccttaacccgttaccccggttacccgttaccttaacggttaacgttaacgg

SEQ ID NO: 441459 - DNA, 626 bp, Homo sapiens
  misc_feature: GZ8MTXP01BZP11.11.57.F02.1.454.CMB.2.raw
  modified_base (262)..(262): a, c, t, g, unknown or other
  modified_base (283)..(283): a, c, t, g, unknown or other
  modified_base (593)..(593): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtacaaaatataacaactacttagcctgttccaanagaacctgcaggctccaggcnctcatctatgatgactagtttagggacgggtccacgtcggcctacgtcccccaccgtagggtttcaggttcggcgtagggttcggggtctcgggggactaggtactttcactttccaccaacctacgtcccgactacgtcccgtaagacgtacctagtaagtattttcgacttaagtttacttacgtcgttacaacgtaggacgttaagctacggacgacgggtcccgtaccgggccgtaccggtccggaccgaacggggtaaccgaaggggtacgaacgtacgaaggcgtaacgttgtcggctcgcacnttcgttcgtctctactccttcccgtcttcttcg

SEQ ID NO: 441460 - DNA, 643 bp, Homo sapiens
  misc_feature: GZ8MTXP01C10KN.11.57.F02.1.454.CMB.2.raw
  modified_base (151)..(151): a, c, t, g, unknown or other
  modified_base (205)..(205): a, c, t, g, unknown or other
  modified_base (264)..(264): a, c, t, g, unknown or other
  modified_base (286)..(286): a, c, t, g, unknown or other
  modified_base (468)..(468): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccgganaaattgtgttgacacagtctccggccaccctgtctgcgtctccgtggggaaacngtccacctctcctgcaggccagtacaaaattataacaactacttagcctggttaccaanagaacctgcagctccagctccnatctatgatgactagtttagggacggccacgtcggactacgtaccccaccgtacggtttcaggttggcgaggttcgggtctacggggaccaggtctttcacgttcccacgtaaccacgtcccgactacgcccgtagacgtctagtagttatttgacttagtttattacgtacgttacaacgngcgtaagacgtagcggacgggtcccgtccgggacgtaccggttccggaccggtaaacgggaacccgaaggggttacggaaacggtcgaaacggtcggtaaacgttggtcggctggacccttacgttacttccgttcgttccttctaccttccgttcccgtaaccttaagtttccg

SEQ ID NO: 441461 - DNA, 716 bp, Homo sapiens
  misc_feature: GZ8MTXP01AKPEE.11.57.F02.1.454.CMB.2.raw
  modified_base (265)..(265): a, c, t, g, unknown or other
  modified_base (276)..(276): a, c, t, g, unknown or other
  modified_base (282)..(282): a, c, t, g, unknown or other
  modified_base (284)..(284): a, c, t, g, unknown or other
  modified_base (344)..(344): a, c, t, g, unknown or other
  modified_base (353)..(353): a, c, t, g, unknown or other
  modified_base (369)..(369): a, c, t, g, unknown or other
  modified_base (371)..(371): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacagtccaccctctcctgcagggccagtacaaaatattaacaactactagcctggtccaacanaacctgcagcnccagcncncatctatgatgctagtttagggacggccagtggccactccccgacctaggttcagtggcnggtgggtcncgggacagctcattcncncatccgcacgtccgtagactccgtagtaagtactttgcgttagtttaacttactcgtactaaacgacggttacgtacgtacgtacgaccggggtacgggtccccggttcccgggaccggttaaccggggtttacccgggaacccgggtaaaacgggggtaaaccccgggaaacggggttaaccggggtaaaacggttcccgaaaaacggggtccggtaaaaccggtttggggtaacccggggctttaacccggggaaccttaaccccgttacgttttccggtaacggtttccgtttaacccgtaacttttcccccgttacccgaacccgttaagttttaacccgg

SEQ ID NO: 441462 - DNA, 728 bp, Homo sapiens
  misc_feature: GZ8MTXP01A7V4S.11.57.F02.1.454.CMB.2.raw
  modified_base (266)..(266): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctccgtggggaaacagtccaccctctcctgcagggccagtacaaaatataaacaactacttagcctggtaccaanagaacctgccaggctccaggctcctcatctatgatgctagtttagggacgggtacccacgtcggacacctcccccgacccgttaggtttccaaggtcggacgtaggtcggggtcgtcgggggaactaggtacctttacgactttaaccctaccaaccccgtaactccccgggactaacggtaccccctaagggtaaaccgttaccctagggtaaacgttagttttttacggactttaaaggtttttaactttaaccgttgttaaaccctaaacggtacggtacggtacgaacgaacgtaccggggaccgggtccgtacccgggtaccggtaccggtaccgggacccgaacgggaaccgtaagggtacggaacgttacgaaacgcggtaaacgttggtcggcgtacggtccaaccgttcttcgtaacgttacttcgtactccttccccgtaacttcgttaacg

SEQ ID NO: 441463 - DNA, 615 bp, Homo sapiens
  misc_feature: GZ8MTXP01AHH95.11.57.F02.1.454.CMB.2.raw
  modified_base (204)..(204): a, c, t, g, unknown or other
  modified_base (254)..(254): a, c, t, g, unknown or other
  modified_base (256)..(256): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (268)..(268): a, c, t, g, unknown or other
  modified_base (271)..(271): a, c, t, g, unknown or other
  modified_base (273)..(273): a, c, t, g, unknown or other
  modified_base (353)..(353): a, c, t, g, unknown or other
  modified_base (424)..(424): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccacggagaaattgtgttgacacagtcctccggccaccctgtctgcgtctccgtggggaaacngtccaccctctcctgcaggccagtacaaatataacatactagctgtcaananaacngcngcncngcncnatctatgatgctagtaggagtccagtgcactcccactaggttcaggtcgcaggtggtctgggacaggtactcagttaccncgaacactcccgacacgtccctaagccgtctagaacgttagtttcgacttagtttatacgtcgtacaacgngtaccgtgacaaggcggtacggtcccgtccgggtacgtaaccgttccggggaccgaaacgggaccgtaaagggtacgggaaacgttacgaacggaacggtaaaccgttggtcggttaccgtcgtaaccacccggttaattccgttaacgtcttaacgttaaccctccgtttccccgaacttaacgttccgg

SEQ ID NO: 441464 - DNA, 533 bp, Homo sapiens
  misc_feature: GZ8MTXP01E0K70.11.57.F02.1.454.CMB.2.raw
  modified_base (200)..(200): a, c, t, g, unknown or other
  modified_base (239)..(239): a, c, t, g, unknown or other
  modified_base (403)..(403): a, c, t, g, unknown or other
  modified_base (452)..(452): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacnctgaccacacggtacgtgctgttgtactgctcctcccgnggtctttgtcttggcattatgcacctccacgccgtccacgtaccagtgaacttgacctcagggtctcgtggctcacgtccaccaccacgcatgtgacctcgaggggtccgccaggctccccgaggtagggctggatgggatttcatacattagcagtagtggtnacgaccatatactacgcagactctgtgaagggccatcatcatctccagngacaatggcaaacaaacttcaactgttatcttaggaaatccaacagccctggagaagtcgagggacctaacgggcttaagg

SEQ ID NO: 441465 - DNA, 724 bp, Homo sapiens
  misc_feature: GZ8MTXP01A1434.11.57.F02.1.454.CMB.2.raw
  modified_base (208)..(208): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctggtttcctgttgctatttagaagtgtccagtgcgaggtgcaagtggtgcagtcgngggggagcttagtccgaggccgggggtcctgagactctcctgtctagtctcgtggtattcgctacagtgactatgacctagtgaaggtcgggtcccgaccgtaggcctaccggtaggggtaaacgggggcttagggaaagttcgggtaatttaccgaattaaccgtagttaacggtaccgtaaggttaggtacggggttcgaaaccggaaaccctaagtaaacgtaaccttaaaccgggaccgtaaaggtaaccgttcgttacgggtacgggtaaacgggggtaccctagtttaccaacgttaccaacttccctaccgaagtaacgaacctaacgtaggacccaaacgtaacctacctacgttaataacctacgtaacggaaaactaccgaaacgcgtaccgtagaacggtaacggtaccgaaggggaccttaacgggtacttaacggttaatttagttacgttaaggcggtccggtaacggacccggttacccccgtaagggttccgaacccggg

SEQ ID NO: 441466 - DNA, 595 bp, Homo sapiens
  misc_feature: GZ8MTXP01BYPLR.11.57.F02.1.454.CMB.2.raw
  modified_base (204)..(204): a, c, t, g, unknown or other
  modified_base (263)..(263): a, c, t, g, unknown or other
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtccaccctctcctgcagggccagtacaaaatattaacaactacttagcctggtccaanagaaacctgcaggctccaggcncctcatctatgatgctagtttagggacgggccacgtcggcactaccccgacccgtacgggtttcaggtggcgtaggtggggtcgtcggggaccagtacttcgattcctacaaccactccgcacgcctagagcctagaatatttgctagtttattactgtacaacacgcgtagcgtagcgacggtcccgtacggcgtaccggtcgaccgaagggaaccgaggtcggaagtacgaaggaacgtaacgttcggtcggcgtcgcttacgacgttccgttctccttctacttccttccccgaacgttcttaaccg

SEQ ID NO: 441467 - DNA, 928 bp, Homo sapiens
  misc_feature: GZ8MTXP01B84HM.11.57.F02.1.454.CMB.2.raw
  modified_base (367)..(367): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtggggaaacagtccaccctctcctgcgagggccagtacaaaatattaaacaactacttagcctgttaccaacacgaaacctggccacgcctcccaggctctcatctatgagtgtcgtaagtttacgggacggcctacgtcggacctaccgtcccccgaacccgtgggtttacnggtcggtcgtagggtgggtacgtcggggaactacggtacctttacgtacttacccttacccgaacccgtacgttaccccggaccgtaaacgggtccccccgttaaagggtaccggaccccgtttaaggtttaacggtttaaaacggttttttcggtaccggtttttaaaacgttttttaaccgtttttaaacccggtttacgtttaaacccgttaaaccgggtacgggttaaccggttaaccgggtaccgttaacccgggggaccgggttaacccgggggttaacccccccggttcccgggggtaccccggggtttaacccgggggtttaacccccggggtaacccgggggaaaaaacccgggggttaacccggggtaaaacggggtaaccggggggtaaaccggttaacccgggtaaaacggttaacccggggtaaaccgtttcgggggaaccggttacggtacccgggtaaccgttaacccgttacggttcccgttttaacgtcccgtttaaccgtaacccgtttcccgttaccccgtaaccccgttaagttttcccgg

SEQ ID NO: 441468 - DNA, 733 bp, Homo sapiens
  misc_feature: GZ8MTXP01C3R6Y.11.57.F02.1.454.CMB.2.raw
  modified_base (288)..(288): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggcaccctgtctgcgtctcctggggaaacagtcaccctctcctgcagggccagtacaaaagtattaaacaactacttagctggttccaacagaaacctggccaggctcccaggcncctcatctaatcgatgactaagtttaggacggggtcccacgtggaccattacccccaacccgtagggtttaccaaggttcggacaggtcggggtctacggggactaggtacttacgtactttactaccaacccgtacgttaccccgacgacgtaccccttaaggaacgtacccgttagtaaaggttaacttttacgggtaccttaagttttaaacttacgtacgttaacaaacgtacggacgtaagacacggtcgacggtcccgtcccggacgtaccggttaccggacccgtaaacgggtaaacccgaaaggggtacggtaaacggttaaccgaaaggcccgtaaaacggttcggttaacggccgttacgacccgaaccaacgttcccgttaacgttccttaaccttaacggttcccttttccccgaacccgttaaccgtttccg

SEQ ID NO: 441469 - DNA, 516 bp, Homo sapiens
  misc_feature: GZ8MTXP02JFZ8D.11.57.F02.1.454.CMB.2.raw
  modified_base (370)..(370): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgcatttaggagggccactggcatcccaccaggttcagtggcagtgggtctggggacagacttcattctcnccatcccgcagcctagagccctgagattttgctagtttattactgttcaactagcgtagcagcaggcctcggcgacgttcggcaagggaccaaggtggaagtcaagcgaactgtggctgcaccatctgtcttcactctcccgcatc

SEQ ID NO: 441470 - DNA, 530 bp, Homo sapiens
  misc_feature: GZ8MTXP02JHCJJ.11.57.F02.1.454.CMB.2.raw
  modified_base (203)..(203): a, c, t, g, unknown or other
  modified_base (261)..(261): a, c, t, g, unknown or other
  modified_base (486)..(486): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctcctcatctatgatgcatttaggaggccactggcatcccaccaggttcagtggcagtggtctgggacagacttcattctcaccatccgcagccctagagccctagaagtattttgctagtttattactgtacaacagcgtagcagcaggcctccggcgacgtcgcgaacggacgaacgtaggagtacgacgacgacgtagnggtcgacggcaccactactgtcttctactcttcctccacttacg

SEQ ID NO: 441471 - DNA, 515 bp, Homo sapiens
  misc_feature: GZ8MTXP02I495B.11.57.F02.1.454.CMB.2.raw
  modified_base (202)..(202): a, c, t, g, unknown or other
  modified_base (239)..(239): a, c, t, g, unknown or other
  modified_base (364)..(364): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttaacngctacttagcctggtaccaacagaaacctggccagactcccaggctcctcatctatgatgcatccaacagggccactggccaccccagccaggttcagtggcagtgggtctggggacagacttcnctctcaccatccagcagcctagacgcctgaggtattttgctagtttattactgtcagcagcgtatcgactggactcaccttcggaccaagggacacgactaggaaaattaaacgacgtgacgctcgcacaatctgtcttcactcttcccgc

SEQ ID NO: 441472 - DNA, 526 bp, Homo sapiens
  misc_feature: GZ8MTXP02JN8MZ.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccaccaggttcagtggcaggtgggtctggggacagacttcattctcaccatccgcagcctagacgccctagagtattttgctagtttattactgtcaacagcgtagcagcaggcctcggcgacgttcggaccgaagggaccaaggtggaagtcaagcgaactggtcggctgcaccatctgtcttcactcttcccgctactcg

SEQ ID NO: 441473 - DNA, 534 bp, Homo sapiens
  misc_feature: GZ8MTXP02JJRCU.11.57.F02.1.454.CMB.2.raw
  modified_base (379)..(379): a, c, t, g, unknown or other
  modified_base (476)..(476): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtggcagtgggtctggggacagacttcattctcaccatcccgnagcctagacgcctgaagtattttgctagtttattactgtacaagtagcgtagcagcacggcctccggcgacgttcggaccgaaggggacccaaaggnggaagtcgaaaggcgaaactggtcggctcgcaccagtctgtctacatcctccgcatcg

SEQ ID NO: 441474 - DNA, 519 bp, Homo sapiens
  misc_feature: GZ8MTXP02I3WP3.11.57.F02.1.454.CMB.2.raw
  modified_base (367)..(367): a, c, t, g, unknown or other
  modified_base (369)..(369): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatccccaccaggttcagtggcagtgggtctggggacagacttcattcncnccatccgcagcctagagcctgaagtatttgctagtttattactgtcaacagacgtagcagcaggcctccgggcgacgttcggaccaagggaccaaggtggaagtcgaagcgaactggtggctgcaccatctgtcttcactctcccgcatc

SEQ ID NO: 441475 - DNA, 546 bp, Homo sapiens
  misc_feature: GZ8MTXP02HJT4K.11.57.F02.1.454.CMB.2.raw
  modified_base (355)..(355): a, c, t, g, unknown or other
  modified_base (467)..(467): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgcggtcttttgtcttggcattatgccacctccacgcccgtccacgtaccagttgaacttcgacctcaggtctcgtgctcacgtccaccaccacgcatgtcgacctcgacggggtccnccaggcctcccgagggtagggctaggatggatttcatacattagctagtacgtggcgacgacatactactacgcagactcgtgtacgaaggcctaattcatcatcaccaganacaatcgacaacactcactagtatctaggaaactcgaaacacgacctaagaagacgtacggacggacgacggtattaag

SEQ ID NO: 441476 - DNA, 544 bp, Homo sapiens
  misc_feature: GZ8MTXP02JLL60.11.57.F02.1.454.CMB.2.raw
  modified_base (291)..(291): a, c, t, g, unknown or other
  modified_base (351)..(351): a, c, t, g, unknown or other
  modified_base (371)..(371): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctnatctatgatgcagtttaggagggccatggcatccccaccaggttcagtggcaggtggtcnggggacagacttcattctcnccatccgcagcctagacgccctagaacgtattttgactagtttattactgtacaactagcgtagcagacaggcctccgggcgacgttcggaccgaagggaccaaggtggaagtacgaaaggcgaaactggtacggctcgaccaccatctgtcttcacttccttcccgctatcg

SEQ ID NO: 441477 - DNA, 564 bp, Homo sapiens
  misc_feature: GZ8MTXP02FP98Z.11.57.F02.1.454.CMB.2.raw
  modified_base (261)..(261): a, c, t, g, unknown or other
  modified_base (366)..(366): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcatttaggagggccactggcatcccaccaggttcagtgcagtggtctgggacagacttcattcctnaccatccgcagccctagacgcctagaagtattttgctagtttattactgtacaacagcgtagcagcaggcctccggcgacgttccggacgaacgggaccgaaagggtggaaagtcgaaacggacggtaaacgtggtcgggtactcggacacctattctcggttctttaccacttccctttacccggcctacgtttccg

SEQ ID NO: 441478 - DNA, 638 bp, Homo sapiens
  misc_feature: GZ8MTXP02GT71R.11.57.F02.1.454.CMB.2.raw
  modified_base (367)..(367): a, c, t, g, unknown or other
  modified_base (369)..(369): a, c, t, g, unknown or other
  modified_base (377)..(377): a, c, t, g, unknown or other
  modified_base (386)..(386): a, c, t, g, unknown or other
  modified_base (395)..(395): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaatattaacaactacttagcctggttccaacagaaacctggccaggctcccaggctcctcatctatgatgctatttaggagggccatggcatccccaccaggttcagtggcaggtggtctgggacagacttcattcncnccatccgnagcctagancctgaagtntttgactagtttattactgtacaacgtagtacgtagacaggaccgacgggcccttccgggccggtaaccgggtttccgggaacccgaaacgggggtaacccgaaaggggttacgggaaacggttcgaaaacggaccggtaaaaccgttgggttacgggccgttacggacccgaaccctaagttcccgttaaggttccctttacgtaaacctttcccgtttcccccggtaccctaactttcccg

SEQ ID NO: 441479 - DNA, 550 bp, Homo sapiens
  misc_feature: GZ8MTXP02HAGYX.11.57.F02.1.454.CMB.2.raw
  modified_base (204)..(204): a, c, t, g, unknown or other
  modified_base (371)..(371): a, c, t, g, unknown or other
  modified_base (373)..(373): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcagtttaggagggccactggcatccccaccaggttcagtggcaggtgggtctggggacagcttcatttcncnccatccgacacgcctagacgccctagaagtattttgactagtttattactgtacaacgagcgtagcagcacgggcctccgggcgtacgtcggccgaagggaccaaggtggaagtcgaacggcgaaacgtggtacggctcggctaccgatctgtcttactcgttctcccgtctactcg

SEQ ID NO: 441480 - DNA, 523 bp, Homo sapiens
  misc_feature: GZ8MTXP02GUST1.11.57.F02.1.454.CMB.2.raw
  modified_base (236)..(236): a, c, t, g, unknown or other
  modified_base (254)..(254): a, c, t, g, unknown or other
  modified_base (341)..(341): a, c, t, g, unknown or other
  modified_base (493)..(493): a, c, t, g, unknown or other
  modified_base (499)..(499): a, c, t, g, unknown or other
tcagcgagagataccacgaccggtgctcgatttagctcgatatagttgggtttggggcagggtgtacacctgtggttctcggggctgccctttggctttggagatggttttctcgatggggctgggagggctttgttggagaccttgcacttgtactccttgccattcagccagtcctggtgcaggacggtgaggacgctgaccacacggtacgtgctgttgtactgctcctccgnggctttgcttggcattangcacctcacgccgtcacgtaccagttgaacttgacctcagggtcttgtgctcacgtccaccacacgcatgtgacctcgaggggtccnccaggctccccgagggtaaggggctggaatggatttcatacattagcagtagtggtgcgaccatatactaacgcagactctgtagaaggccgattcatcattcaccagagacaatcggcaaacactcactagtatctaggaaactcaaaacngtaccngacgagtacgaggacacggcttag

SEQ ID NO: 441481 - DNA, 509 bp, Homo sapiens
  misc_feature: GZ8MTXP02I48U6.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccggggggtccctgagactctcctgtctagtctctggattcgccttcagtgactatgccatgagtggtccgccaggctccgaggtaaggggctgggaatggatttcatacattagcagtagtggtgcgacatatactacgcagactctgtgaagggccattcatcatctccagagacaatggacaacaactcactgtatctaggaaatcaaacagcctagagacgtcgaaggacacggctgtatattatcgtgacgagacgccccctaggtcgaccg

SEQ ID NO: 441482 - DNA, 510 bp, Homo sapiens
  misc_feature: GZ8MTXP02I23FD.11.57.F02.1.454.CMB.2.raw
  modified_base (182)..(182): a, c, t, g, unknown or other
  modified_base (261)..(261): a, c, t, g, unknown or other
  modified_base (363)..(363): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctntctgcgtctcctggggaaacagtcaccctctcctgcagggccagtcaaaatattaacaactacttagcctggttccaanagaaacctgcaggctccagctctcatctatgatgcatttagagggccactggcatcccacccaggttcagtggcagtgggtctgggacagacttcattctcnacccccccccctgccagcctagagcctgaagatttgcagtttattacttgtcaacagcgtagcagcaggctccggcgacgtcgcaggaccgaaggtggaagtcaagcgaactgtggctgcaccatctgtcttcatcttccgcctatc

SEQ ID NO: 441483 - DNA, 537 bp, Homo sapiens
  misc_feature: GZ8MTXP02JZX5H.11.57.F02.1.454.CMB.2.raw
  modified_base (371)..(371): a, c, t, g, unknown or other
  modified_base (427)..(427): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggcccaggctcccaggctcctcatctatgatgcatttaggagggccactggcatcccacccaggttcagtggcagtgggtctggggacagacttcattctcnccatcccgcagccctagacgccctgaaagtattttgctagtttattactgtcaacngcgtagcagcaggcctcggcgtacgttcgaccgaaggaccgaaggtggaagtcaaggcgtaaacgtgtacggctacggcaccgtatctgtcttcacttctcccgctatcg

SEQ ID NO: 441484 - DNA, 531 bp, Homo sapiens
  misc_feature: GZ8MTXP02IA6Y6.11.57.F02.1.454.CMB.2.raw
  modified_base (369)..(369): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatccccacccaggttcagtggcagtgggtctggggacagcttcatttcncaccatcccgcagccctagacgccctagaagattttgctagtttattactgtacaactagcgtagcagcaggcctcgggcgacgttcggcgaagggaccgaaggtggaagtcgaagcgaacgtggtcggctgccaccatctgtcttcactccttcccgcatc

SEQ ID NO: 441485 - DNA, 517 bp, Homo sapiens
  misc_feature: GZ8MTXP02FZ1JD.11.57.F02.1.454.CMB.2.raw
  modified_base (262)..(262): a, c, t, g, unknown or other
  modified_base (367)..(367): a, c, t, g, unknown or other
  modified_base (417)..(417): a, c, t, g, unknown or other
  modified_base (498)..(498): a, c, t, g, unknown or other
  modified_base (512)..(512): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcatttaggagggccatggcatcccaccaggttcagtgcagtgggtctgggacagacttcattctcnccatccgcagcctagacgcctgaagtatttgctagtttatactgtacaanagcgtagcagcaggcctccggcgacgttccgccgaagggaccaaggtggaagtcgaagcgaacgtgtggctgcaccgatcngtctcatccttccncatcg

SEQ ID NO: 441486 - DNA, 502 bp, Homo sapiens
  misc_feature: GZ8MTXP02HDO14.11.57.F02.1.454.CMB.2.raw
  modified_base (362)..(362): a, c, t, g, unknown or other
tcagcgagagataccacgaccggtgctcgatttagctcgatatagttgggtttggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccggggggtccctgagactctcctgtctagtctctggattcgccttcagtgactatgccatgaagtggtccgccaggctccaggtaaggggctgggaatggatttcatacattagcagtagtggtgcgaccntatactacgcagactctgtgaagggccgattcatcatctccagagacaatggcaaacaactcactgtatctggaaatcaaacagcctgagacgtcgaggacaggctgtatattatgtgcgagacgccccctaggtcgacg

SEQ ID NO: 441487 - DNA, 515 bp, Homo sapiens
  misc_feature: GZ8MTXP02IVYQN.11.57.F02.1.454.CMB.2.raw
  modified_base (423)..(423): a, c, t, g, unknown or other
  modified_base (445)..(445): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggtttccttgttgctattttagaaggtgtccagtgcgaggtgcaagtggtgcagtctgggggagcttagtccaggccggggggtccctgagactctcctgtctagtctctggattcgccttcagtgactatgccatgaagtgggtccgcaggctccgaggtaagggctggaatggatttcatacattacgcagtagtggtgcgaccatatactacgcagactctgtagaaggccgattcatcatctcagagacaatggacaaacactnactgtatctaggaaatcaaacngacctagagtacgtacgaggacacggctgtaatattatgtgacgacgaccgacccccgtaggtcgaccgg

SEQ ID NO: 441488 - DNA, 550 bp, Homo sapiens
  misc_feature: GZ8MTXP02IU9RB.11.57.F02.1.454.CMB.2.raw
  modified_base (204)..(204): a, c, t, g, unknown or other
  modified_base (262)..(262): a, c, t, g, unknown or other
  modified_base (366)..(366): a, c, t, g, unknown or other
  modified_base (419)..(419): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctcctcatctatgatgcatttaggagggccatggcatcccaccaggttcagtgcagtggtctgggacagacttcattctcncatccgcagcctagacgcctagaagtattttgactagtttattactgtacaanagcgtagcagcacggcctaccgggcgacgttcggaccaaggggaccaaagggtggaagtacgaacgtcgaaacgtggtcggacgttcgacgacctatcgtgtccttcacttcctttacccgcctaattccg

SEQ ID NO: 441489 - DNA, 537 bp, Homo sapiens
  misc_feature: GZ8MTXP02JQHXK.11.57.F02.1.454.CMB.2.raw
  modified_base (365)..(365): a, c, t, g, unknown or other
  modified_base (385)..(385): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccaccaggttcagtggcagtgggtctgggacagacttcattcncaccatccgcagcctagacncctagaagtattttgactagtttattactgtactaacagtcgtagcagcacggcctcggcgacgttcggaccgaacgggaccaagggtaggaagtacgaaacgcgaaacgtggtacggctggccacatctgtctacactccttccgcactcg

SEQ ID NO: 441490 - DNA, 520 bp, Homo sapiens
  misc_feature: GZ8MTXP02JTRHV.11.57.F02.1.454.CMB.2.raw
  modified_base (262)..(262): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggcccaggctcccaggctcctcatctatgatgcatttaggagggccactggcatcccaccaggttcagtggcagtggtctgggacagacttcattcctcaccatccgcagcctagacgcctgaagtatttgctagtttattactgtcaacagcgtagcagcgaggcctcggcgacgttcggccgaagggaccgaaggtaggaagtcgaaggcgaacgtgtaggctgcacatctgtctcactctccgcatc

SEQ ID NO: 441491 - DNA, 553 bp, Homo sapiens
  misc_feature: GZ8MTXP02I1XJL.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccagtggcatccccaccaggttcagtggcaggtggtctggggacagacttcattctcaccatcccgcagcctagacgcctagaagtatttgctaagttttattactgtacaacagcgtagcagcacggcctccggcgtacgttcggccgaaagggaccgaaagggtggaagtcgaaaggcgaaacgtggtcggacgtgacctaccgattcgtcgtcttcgacttccttccccgctactccg

SEQ ID NO: 441492 - DNA, 589 bp, Homo sapiens
  misc_feature: GZ8MTXP02HYED0.11.57.F02.1.454.CMB.2.raw
  modified_base (378)..(378): a, c, t, g, unknown or other
  modified_base (400)..(400): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctgtccaacagaaacctggccaggctcccaggctcctcatctatgatgctagtttaggagggtccacgtggcactccccacccaggttcagtggcaggtgggtctggggacagtacttcatttccncacctatccgcagccctagacnccctagaagtattttgctagtttattactgtacaaacagcgtaagcagcgacggccctcgggccgtacggttcggacccgaaaggggacccaaaggggtacggaaacgtacgaaacggacgaaaacgtggtacggcctacggaccaaccgtattctcgttcttacgacttcccttccccgctaactccg

SEQ ID NO: 441493 - DNA, 554 bp, Homo sapiens
  misc_feature: GZ8MTXP02GUPX6.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgctatttaggagggccactggcatccccaccaggttcagtggcagtgggtctggggacagtacttcattctcaccatccgcagccctagacgcctagaaagtattttgctagtttattactgtacaacagcgtagcagcacggtcctccgggcgtacgtcggaccgaagggaccaagggtggaacgtacgaacggacgaacgtgtacggctacggccacctatctcgtcttactacgtccttccgcctacttcg

SEQ ID NO: 441494 - DNA, 510 bp, Homo sapiens
  misc_feature: GZ8MTXP02HSWVN.11.57.F02.1.454.CMB.2.raw
  modified_base (363)..(363): a, c, t, g, unknown or other
  modified_base (382)..(382): a, c, t, g, unknown or other
  modified_base (415)..(415): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaatataacaactacttagcctggttccaacagaaacctggccaggctcccaggctcctcatctatgatgcatttaggagggccatggcatcccaccaggttcagtgcagtgggtctgggacagacttcattccnaccatccgcacgcctagancctgaatattttgctagtttattactgtcaacngcgtagcagcaggcctcggcgacgtcggacagggaccaggtgaagtcagcgaactgcggactggcacgatctgtcttacactcttcccgctatcg

SEQ ID NO: 441495 - DNA, 527 bp, Homo sapiens
  misc_feature: GZ8MTXP02JZ2BH.11.57.F02.1.454.CMB.2.raw
  modified_base (370)..(370): a, c, t, g, unknown or other
  modified_base (423)..(423): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcnccatccgcagcctagagcctgaagtattttgctagtttagttactgtacaacngacgttagcagcacggcctccggcgacgttcgaccgaagggaccaaggtggaagtcgaagcgaactggtcggctgcacatctgtcttcactcttcccgcactcg

SEQ ID NO: 441496 - DNA, 519 bp, Homo sapiens
  misc_feature: GZ8MTXP02GF46W.11.57.F02.1.454.CMB.2.raw
  modified_base (362)..(362): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccatggcatcccaccaggttcagtgcagtggtctgggacagacttcattcncaccatccgcagccctagagcctagaaagtatttgctagtttattactgtacaacagcgtagcagcacggcctccggcgacgttcggacccaagggaccaaaggtggaaagtcgaagcgaaacgtgtcggctgcacatctgtctcatcctccgcatc

SEQ ID NO: 441497 - DNA, 650 bp, Homo sapiens
  misc_feature: GZ8MTXP02JSWKT.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcagtttaggagggccatggtactccccacccgaggttcagtggcagtgggtctgggaccagacttcattctcaccatccgcagcctagacgcctagaaagtattttgactagtttattacgtagttacaaacgtacgacgttaaggccaaaggccgaacgggtccccgttacccggggccggtaaccggtttccggggacccgaaaacgggggtaccccaaaagggggttgggaaacggttacgaaaacggacggtaaaactggggtacgggacttcgggacctaacccgaagttccttggtccgtttccaaacttcccgtttcccccggacctaacgtcccttaacgg

SEQ ID NO: 441498 - DNA, 531 bp, Homo sapiens
  misc_feature: GZ8MTXP02I2HSR.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctggggacagacttcattctcaccatccgcagcctagagcctgaagtattttgctagtttattactgttacaacagcgtagcagcacggcctccgggcgaccgttcggccaagggccaaaggtggaaagtcgaagcgaaactgtcggactgcaccatctgtcttcactcttacccgcacttcg

SEQ ID NO: 441499 - DNA, 518 bp, Homo sapiens
  misc_feature: GZ8MTXP02JDRU9.11.57.F02.1.454.CMB.2.raw
  modified_base (370)..(370): a, c, t, g, unknown or other
  modified_base (388)..(388): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctggggacagacttcattctcnccatccgcagcctagacncctgaagattttgctagtttatactgtcaacagcgtagcagcaggcctccggcgacgttcggccaagggaccaaggtggaagtcaagcgaactgtacggctcgcaccgatctgtcttcactctccgcatc

SEQ ID NO: 441500 - DNA, 552 bp, Homo sapiens
  misc_feature: GZ8MTXP02JLZ1L.11.57.F02.1.454.CMB.2.raw
  modified_base (369)..(369): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatataacaactacttagcctggttccaacagaaacctggccaggctcccaggctcctcatctatgatgcatttaggagggccactggcatcccacccaggttcagtggcagtgggtctggggacagacttcattctcnccatcccgcagcctagacgccctagaaagtattttgactagtttacttactagtcaaacagcgtagcagcacggcctcggcgacgttcggaccgaagggaccgaggtaggaagtacgaagacgaaacgtggtagggctacggccaccgatactgtcttacactccttacccgcctacgttccg

SEQ ID NO: 441501 - DNA, 525 bp, Homo sapiens
  misc_feature: GZ8MTXP02GNG75.11.57.F02.1.454.CMB.2.raw
  modified_base (389)..(389): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttcagtggcaggtgggtctggggacagacttcattctcaccatccgcagcctagancctgaacgtatttgactagtttattactgtacaacagcgtagcagcacggcctccggcgacgttcggaccgaagggaccaagggtgaagtacaagcgaactgtacggctgcaccatctgtctcatctccgctactc

SEQ ID NO: 441502 - DNA, 549 bp, Homo sapiens
  misc_feature: GZ8MTXP02J1NQ0.11.57.F02.1.454.CMB.2.raw
  modified_base (372)..(372): a, c, t, g, unknown or other
  modified_base (429)..(429): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccacccaggttcagtggctaggtgggtctggggacagacttcattctcnccatcccgcagcctagacgcctgaagtattttgcttaggtttattactgtacaacgngcgtagcagcacggcctccgggcgtacgttcggaccgaaggggacctaagggtggaacgtcgaaagcgtaaacgtggcgggactcgacaccgatctgtctacactccttcccgcacttcg

SEQ ID NO: 441503 - DNA, 502 bp, Homo sapiens
  misc_feature: GZ8MTXP02GAITA.11.57.F02.1.454.CMB.2.raw
  modified_base (359)..(359): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccggggggtccctgagactctcctgtctagtctctggattcgccttcagtgactatgccatgaagtggtccgcaggctccaggtaagggctggaatggatttcatacattagcagtagtggtgcgacntatactacgcagactctgtgaaggccgatcatcatctccagagacaatggacaacaactcactgtatctaggaaatcaaacagacctgagagtcgaggacacggctgtatattatgtgacgacgacgcccctacggtcgtacg

SEQ ID NO: 441504 - DNA, 572 bp, Homo sapiens
  misc_feature: GZ8MTXP02IBTSD.11.57.F02.1.454.CMB.2.raw
  modified_base (288)..(288): a, c, t, g, unknown or other
  modified_base (372)..(372): a, c, t, g, unknown or other
  modified_base (393)..(393): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaacaactacttagcctggtcaacagaaactggccaggctcccaggctccncatctatgatgctagtttaggagggccactggcactccccacccaggttcagtggcaggtgggtctggggacagacttcattcncaccatcccgcagcctagacnccctagaagtattttgacttagtttattactgtacaacgagtcgtagcagcaggcctcggcgtacgtcggaccgaaagggaccaagggtagaagtacgaaaggtcgaaacgtggacgcgtacggaccaccctattccgtcgttacctttacaccttcctttcccccggacctaacttcg

SEQ ID NO: 441505 - DNA, 517 bp, Homo sapiens
  misc_feature: GZ8MTXP02IZC2J.11.57.F02.1.454.CMB.2.raw
  modified_base (360)..(360): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttcagtgactatgccatgaagtggtccgcaggctccaggtaaggggctggaatggatttcatacattagcagtagtggtgcgacntatactacgcagactctgtgaaggcgattcatcatctccagagacaatggacaaacaactcactgtactctaggaaatcaaacagacctagacgagtcgaggacacggctgtaatattagtaagtgacgtacgacgcccccgtaggtacgtacccgg

SEQ ID NO: 441506 - DNA, 528 bp, Homo sapiens
  misc_feature: GZ8MTXP02FTPU8.11.57.F02.1.454.CMB.2.raw
  modified_base (204)..(204): a, c, t, g, unknown or other
  modified_base (353)..(353): a, c, t, g, unknown or other
  modified_base (367)..(367): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccactggcatcccaccagttcagtgcagtggtctgggacngacttcattcctcnccatccgcagccctagacgcctagaagtattttgctagtttattactgttacaacagcgtagcagcagcctcggcgacgtcggcaagggaccgaaggtggaagtcgaaagcggaactggtcgactcgcaccatcgtgtcttcacttccttccgcctattcg

SEQ ID NO: 441507 - DNA, 526 bp, Homo sapiens
  misc_feature: GZ8MTXP02J1727.11.57.F02.1.454.CMB.2.raw
  modified_base (370)..(370): a, c, t, g, unknown or other
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggcccaggctcccaggctcctcatctatgatgcatttaggagggccactggcatcccacccaggttcagtggcagtgggtctggggacagacttcattcncnccatcccgcagcctagacgccctgaagtattttgctagtttatactgtcaacagcgtagcagcaggcctccggcgacgttcggccgaagggaccaaggtggaagtcgaaagcgaaactgtacggctgcaccatctgtcttcactctcccgcatc

SEQ ID NO: 441508 - DNA, 536 bp, Homo sapiens
  misc_feature: GZ8MTXP02GT43G.11.57.F02.1.454.CMB.2.raw
  modified_base (429)..(429): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtggcagtgggtctggggacagacttcattcctcaccatcccgcacgccctaagacgccctgaagtattttgctagtttattactgtacaacngcgtagcagcacggcctccggcgacgtcggaccgaagggaccgaaggtggaagtcgaaagcgaaacgtgtcggcgtgacgaccatctgtctcactctcccgctactc

SEQ ID NO: 441509 - DNA, 713 bp, Homo sapiens
  misc_feature: GZ8MTXP02I8ZTE.11.57.F02.1.454.CMB.2.raw
  modified_base (233)..(233): a, c, t, g, unknown or other
  modified_base (281)..(281): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaatnttaacaactacttagcctggttccaacagaacctgcagctccagctcnatctatgatgctagtttagggaggccagtcggcactccccacccgtagggtttccaggttcggaccgtaggtcggggttctcggggacacgtactttcactttccctaccacctacgttccccggacgaccgtacccgttaaggaccggtacccgttaggaaagtttagtttttcgaccgtttaaggtttttaacttacgttcgttaaccaaacgtagtaccgtagaccgagaccgaccgggtccccgtcccgggtaccgggttaaccgggttcccggaacccgggtaaacggggtaacccggtaaaggggtacgggttaaacgtacggaaaacggaccggtaaaacgttgggcgggtactcgggacccaacctacgttaccgttcgttaccctttactaccgttcccgtttacccccgaccgttacgttcg

SEQ ID NO: 441510 - DNA, 619 bp, Homo sapiens
  misc_feature: GZ8MTXP02I8XE4.11.57.F02.1.454.CMB.2.raw
  modified_base (378)..(378): a, c, t, g, unknown or other
  modified_base (574)..(574): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggtccaacagaactggcaggctccagctcctcatctatgatgctagtttaggagggccacgtggccactccccacccgtaggttccaggtggcaggtggggtctggggacagtacttctattcncaccactccgacacgccctaagactcctagaagtagtttgacttagttttattactgtactaacgagtacgtagacagacgaacggtcccgtccggaccggtaaccggttccggacccgaaaggggacccgaagggttacgggaaacgtacgaaacggaccggtaaactggggtacggcgttacggcctaaccgtntaccgttgtccttacgtacttccctttaccccgccctaatttccg

SEQ ID NO: 441511 - DNA, 534 bp, Homo sapiens
  misc_feature: GZ8MTXP02JK5XS.11.57.F02.1.454.CMB.2.raw
  modified_base (419)..(419): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtgcagtggtctgggacagacttcattctcaccatccgcacgcctagacgcctagagtatttgctagtttatactgtacaacngcgtagcagcacggcctcggcgacgttcggaccgaagggaccaagggtgaacgtacgaacgcgaacgtggtacggctcggaccacgatctgtcttcgacttcctccgccattccg

SEQ ID NO: 441512 - DNA, 522 bp, Homo sapiens
  misc_feature: GZ8MTXP02F2NBY.11.57.F02.1.454.CMB.2.raw
  modified_base (300)..(300): a, c, t, g, unknown or other
  modified_base (364)..(364): a, c, t, g, unknown or other
  modified_base (490)..(490): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcacctctcctgcagggccagtcagagtgttagcaacaacttagcctggtaccagcagaaacctggccaggctcccaggctcctcatctatggtncatccaccagggccactggtactcccagccaggttcagtgcagtgggtctggggacagagttcnctctcaccatcagcagcctgcagtctagaagtatttgcttagtttttactgtcagcagtatagtaactggcctccgtactactttggcctaggggaccagactaagaaactacaaaacgaactagngactgacaaccatctcgtcttcactcttcccg

SEQ ID NO: 441513 - DNA, 595 bp, Homo sapiens
  misc_feature: GZ8MTXP02H5LE5.11.57.F02.1.454.CMB.2.raw
  modified_base (281)..(281): a, c, t, g, unknown or other
  modified_base (374)..(374): a, c, t, g, unknown or other
  modified_base (376)..(376): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatataacaactattagcctgtcaacagaaactggcaggcctccagctcncatctatgatgctagtttaggagggtccagtggcactccccaacctaggttcaggtggctaggtggggtctacggggacagtacttcatttcncnccatccgcacgcctaagctcctaagtaagtattttgacttaagtttacttactgtacaaacgacgtcgtaagcaagcacgggtcccgtacgggacggtaccggttcggaaccggaaacggggaccgaaaggggttacggaacggtacgaaaacggcgaaacgttcgggacgactcgaccacctatcgtcgttcctcgtaccttcctaccccgctactcg

SEQ ID NO: 441514 - DNA, 540 bp, Homo sapiens
  misc_feature: GZ8MTXP02GI7O1.11.57.F02.1.454.CMB.2.raw
  modified_base (203)..(203): a, c, t, g, unknown or other
  modified_base (261)..(261): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctcctcatctatgatgcatttaggaggccatggcatcccaccagttcagtgcagtggtctgggacagacttcattctcaccatcccgcacgccctaagacgtccctagaaagtattttgactagtttattactgttacaacagacgtagacagcgacggcctccggacgacgttccggaccgaagggaccgaaggtggaaacgtcgaagacgaaacgtggtcgctacgcaccatctgtctcactctccgctactcg

SEQ ID NO: 441515 - DNA, 518 bp, Homo sapiens
  misc_feature: GZ8MTXP02HNU88.11.57.F02.1.454.CMB.2.raw
  modified_base (260)..(260): a, c, t, g, unknown or other
  modified_base (283)..(283): a, c, t, g, unknown or other
  modified_base (340)..(340): a, c, t, g, unknown or other
  modified_base (353)..(353): a, c, t, g, unknown or other
  modified_base (358)..(358): a, c, t, g, unknown or other
  modified_base (368)..(368): a, c, t, g, unknown or other
  modified_base (378)..(378): a, c, t, g, unknown or other
  modified_base (410)..(410): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggtccaanagaaactggcagctccagctccncatctatgatgctatttaggaggccatggcatcccaccaggttcagtgcagtggtcngggacagtacttnattcncaccatccgnagcctagacnctagaatatttgactatttattactgtacaanagactagacagacaggccgtccggacgtacgtcgacgaaggactaaggagagacaagcgaacgtgcgcgcgacacactactcgtcttactactactcctacctactcg

SEQ ID NO: 441516 - DNA, 500 bp, Homo sapiens
  misc_feature: GZ8MTXP02IBZQ3.11.57.F02.1.454.CMB.2.raw
  modified_base (358)..(358): a, c, t, g, unknown or other
tcagcgagagataccacgaccggtgctcgatttagctcgatatagttgggtttggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccggggggtccctgagactctcctgtctagtctctggattcgccttcagtgactatgccatgaagtggtccgcaggctccaggtaaggggctggatggatttcatacattagcagtagtggtgcgacntatactacgcagactctgtgaaggccgatcatcatctcagagacaatggcaacaactcactgtatctaggaaatcaaacagcctgacgagtcgaggacacggctagtatattattgtgacgagacgcccctacggcgtacgg

SEQ ID NO: 441517 - DNA, 602 bp, Homo sapiens
  misc_feature: GZ8MTXP02JUH5S.11.57.F02.1.454.CMB.2.raw
  modified_base (432)..(432): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgcatttaggagggccactggcatccccaccaggttcagtggcaggtgggtctggggacagtacttcattcctcaccatccgcagcctagacgcctagaaacgttatttgctagtttattactgtacaaacgngaccgtagcagtcgacggccgtccgggacgtaccgttcggacccgtaaaggggacccgaaagggtggaaacgtacgaaacggtaccggtaaacgttggcgggtcctcggaaccgaccctaagtccttcggttactttccggactttcccctacccggtctaacgtttccg

SEQ ID NO: 441518 - DNA, 527 bp, Homo sapiens
  misc_feature: GZ8MTXP02HYMM8.11.57.F02.1.454.CMB.2.raw
  modified_base (203)..(203): a, c, t, g, unknown or other
  modified_base (366)..(366): a, c, t, g, unknown or other
  modified_base (385)..(385): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctctcatctatgatgcatttaggagggccactggcatcccaccaggttcagtgcagtgggtctgggacagacttcatttccncaccatccgcagcctaganccctgaagtatttgctagtttattactgtacaacagcgtagcagcacggcctccgggcgaccgttcggaccgaaaggggaccgaaggtaggaagtcaaggcgaacgtgtggctcgcacatctgtcttcactctccgctatcg

SEQ ID NO: 441519 - DNA, 532 bp, Homo sapiens
  misc_feature: GZ8MTXP02GGRLE.11.57.F02.1.454.CMB.2.raw
  modified_base (347)..(347): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccaccaggttcagtgcagtggtcngggacagacttcattcctcaccatcccgcacgccctaagacgccctagaaagtattttgactagtttattactgttacaacagacgtagacagcacggcctccggcgacgttcggacgaaggaccgaaggtgaagtcaagcgaactgtcgactcgcacagtctgtactctactccttccgctatc

SEQ ID NO: 441520 - DNA, 602 bp, Homo sapiens
  misc_feature: GZ8MTXP02IEH6S.11.57.F02.1.454.CMB.2.raw
  modified_base (287)..(287): a, c, t, g, unknown or other
  modified_base (368)..(368): a, c, t, g, unknown or other
  modified_base (388)..(388): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttcaacagaaacctgccaggctccagctcctnatctatgatgcatttaggagggccactggcatccccacccaggttcagtggcaggtgggtctggggacagcttcatttccncaccatccgcagccctaganccctagaagtattttgctagtttattactgttacaactagcgtagacagccgagggtcccttccgggccggaaccgttccgggaccgaaaggggacccgaaagggtcggaaagtcgaaaggacgtaaacgttggtacgggtctacggaccaaccgtacttcgttaaccggttccttttacgactttccctttacccccggacctaactttcccg

SEQ ID NO: 441521 - DNA, 509 bp, Homo sapiens
  misc_feature: GZ8MTXP02GV1XQ.11.57.F02.1.454.CMB.2.raw
  modified_base (368)..(368): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtggcagtgggtctgggacagacttcattctcnccatccgcagcctagagcctagaagtatttgctagtttattactgtcaacagcgtagcagcagctcggcgacgtcgcgaggacgaaggtgaagtcgaagcgaacgtgtcggctgcaccagtctgtctcactctccgcactc

SEQ ID NO: 441522 - DNA, 544 bp, Homo sapiens
  misc_feature: GZ8MTXP02I8E5N.11.57.F02.1.454.CMB.2.raw
  modified_base (289)..(289): a, c, t, g, unknown or other
  modified_base (364)..(364): a, c, t, g, unknown or other
  modified_base (393)..(393): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccaggctccncatctatgatgcatttaggaggccactggcatcccaccaggttcagtggcagtggtctgggacagacttcattcncaccatccgcagcctagcgcctagaagtntttgctagtttatactcgtacaacagtcgtagcagcaggaccgttccgggcgaccgttcggaccgaaggggaccgaaggtggaacgtacgaaaggcgaaacgtggtcgcgtcgacacctagtctcgtcttcacttccttcccgactactcg

SEQ ID NO: 441523 - DNA, 528 bp, Homo sapiens
  misc_feature: GZ8MTXP02G2R0X.11.57.F02.1.454.CMB.2.raw
  modified_base (235)..(235): a, c, t, g, unknown or other
  modified_base (370)..(370): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatnttaacaactacttagcctggttccaacagaaacctggccaggctcccaggctcctcatctatgatgcatttaggagggccactggcatcccaccaggttcagtggcagtgggtctggggacagacttcattctcnccatccgcagccctagagcctgaagtatttgctagtttattactgtcaacagcgtagcagcaggcctccggcgacgttcggaccaagggaccaaggtggaagtcaagcgaactggtaggctcggcaccatctgtcttcactccttacccgcctactcg

SEQ ID NO: 441524 - DNA, 545 bp, Homo sapiens
  misc_feature: GZ8MTXP02GBT1K.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccaccaggttcagtggcagtggtctgggacagacttcattctcaccatccgcacgcctaagagccctgaaagtattttgactagtttattactgttacaaactagacgtagacagcaggcctccgggcgacgttcggaccgaaggaccgaaaggtggaaagtcgaagacgaactggtacggctacgcaccatccgtaagtcttcactcttacccgccattcg

SEQ ID NO: 441525 - DNA, 524 bp, Homo sapiens
  misc_feature: GZ8MTXP02F4VH6.11.57.F02.1.454.CMB.2.raw
  modified_base (433)..(433): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtggcagtgggtctggggacagacttcatttctcaccatccgcagccctagagccctgaagtattttgctagttttaattactgtcaaacagcgtagnagcaggcctccggcgacgtcggccgaagggacaaaggtggaagtcgaaagcgaaacgtgtggctgcaccatctgtcttcactctccgcatc

SEQ ID NO: 441526 - DNA, 523 bp, Homo sapiens
  misc_feature: GZ8MTXP02IDSDT.11.57.F02.1.454.CMB.2.raw
  modified_base (306)..(306): a, c, t, g, unknown or other
  modified_base (357)..(357): a, c, t, g, unknown or other
  modified_base (367)..(367): a, c, t, g, unknown or other
  modified_base (383)..(383): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggaggcttagtccaggccggggggtccctgagactctcctgtctagtctctggatcgccttcagtgactatgccatgaagtgggtccnccaggctccaggtaaggggctgggaatggatttcatacattacgcagtagnggtgcgaccntatactacgcagactntgtgaaggccgattcatcatctccagagacaatggacaaacaactcactgtatcgtagaaatcaaacagcctagaagacgtacgaggactaacggctagtattattagttgagacgtacgaccgtccccgtacggcgacg

SEQ ID NO: 441527 - DNA, 535 bp, Homo sapiens
  misc_feature: GZ8MTXP02FYTJ3.11.57.F02.1.454.CMB.2.raw
  modified_base (370)..(370): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccacccaggttcagtggcagtgggtctgggacagacttcattcctcnccatccgcagcctaagagccctgaagtattttgactagttttaattactgttacaaactagcgtagcaagcaggcctccgggcgacgttcggaccaaggggaccaagggtgaaagtcaagcgaactgtggactgcacatctgtcttcactccttccgccacttcg

SEQ ID NO: 441528 - DNA, 577 bp, Homo sapiens
  misc_feature: GZ8MTXP02JMA4O.11.57.F02.1.454.CMB.2.raw
  modified_base (370)..(370): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaatattaacaactacttagcctggttccaacagaaacctggccaggctcccaggctcctcatctatgatgcatttaggagggccactggcatcccacccaggttcagtggcagtgggtctggggacagacttcattctcnccatccgcagcctagagccctagagtacttttgctagtttattactgtacaacagcgtagacagcacggccctccgggcgaaccggttccgggaccgaaggggacccgtaagggtaggaaacggtcgaaaggacggtaaacgtgtacgggacttcggacaaccgtactcgtcgttccttactactccgtttcccgacctactttccg

SEQ ID NO: 441529 - DNA, 504 bp, Homo sapiens
  misc_feature: GZ8MTXP02G1NRI.11.57.F02.1.454.CMB.2.raw
  modified_base (203)..(203): a, c, t, g, unknown or other
  modified_base (288)..(288): a, c, t, g, unknown or other
  modified_base (363)..(363): a, c, t, g, unknown or other
  modified_base (365)..(365): a, c, t, g, unknown or other
  modified_base (382)..(382): a, c, t, g, unknown or other
  modified_base (415)..(415): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctccaggctccncatcatgatgcatttaggagggccactggcatcccaccaggttcagtgcagtggtctggggacagacttcattcncnccatccgcagcctaganccctgaagatttgcagtttattactgtcaagancgtagcagcaggctcggcgacgtcgcaagggacaaggtggaagtcaagcgaacgtgtaggctgcacagtctgtcttcatctccgcactc

SEQ ID NO: 441530 - DNA, 511 bp, Homo sapiens
  misc_feature: GZ8MTXP02IRUYG.11.57.F02.1.454.CMB.2.raw
  modified_base (354)..(354): a, c, t, g, unknown or other
  modified_base (367)..(367): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaatattaacaactacttagcctggttccaacagaaacctggccaggctcccaggctcctcatctatgatgcatttaggagggccactggcatcccacccaggttcagtgcagtggtctgggacngacttcattctcnccatccgcagcctagagcctgagatttgctagtttattactgtcaacagcgtagcagcaggcctccgggcgacgttcggcaagggaccaaggtgaagtcgaagcgaactgtacgctgcaccatctgtctcactctccgcactcg

SEQ ID NO: 441531 - DNA, 570 bp, Homo sapiens
  misc_feature: GZ8MTXP02IYKT1.11.57.F02.1.454.CMB.2.raw
  modified_base (262)..(262): a, c, t, g, unknown or other
  modified_base (287)..(287): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctgcctcccagataccaccggagaaattgtgttgacacagtctccggccaccctgtctgcgtctcctggggaaacagtcaccctctcctgcagggccagtcaaaatattaacaactacttagcctggttccaanagaacctggccaggctccaggctcncatctatgatgactatttaggagggtccactgggccattccccaacccctaggtttcaggtcggcaggtgggtctggggacagacttcattcctcaccgatccgcagccctagacgcctagagtatttgactagtttattactgtacaactagtacgtagcgagcacggtccctaccggcgtacgttccggacgaaacgggaccgaaagggtggaacgtcgaaaggtcgaaactggtacggctcgaccactactctcgtcttacgactctacccgctacttcg

SEQ ID NO: 441532 - DNA, 596 bp, Homo sapiens
  misc_feature: GZ8MTXP02ITFJL.11.57.F02.1.454.CMB.2.raw
  modified_base (371)..(371): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaatattaacaactacttagcctggttccaacagaaacctggccaggctcccaggctcctcatctatgatgcatttaggagggccactggcactccccaccaggttcagtggcagtgggtctgggacagacttcattcctcncatccgcagcctagagcctgagattttgctagtttattactgtacaacagcgtagcagtcgacggcccgtaccgggcggtaccgttcggaccgaaacggggaccgaaagggtcggaaacgtacgaaacggacggaaaacgtgggttacggacgttcgaccgaccgtaattccgttaacgttaccgtttacctacgtttccctttaccccggtcctaacgtttccg

SEQ ID NO: 441533 - DNA, 578 bp, Homo sapiens
  misc_feature: GZ8MTXP02G20OT.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaacctgcaggctccaggctcctcatctatgatgctagtttaggagggccacgtggcactccccaccagggttcaggtcggcaggtgggtctaggggacagacttcattctcaccatccgcacgcctagacgcctagaagtatttgctagtttatactgtacaacgagcgtagcgagaccgacggtcccgtccgggtaccggtacggttccgggaccgaaacggggaaccgaagggttaggaagtacgaaggacgaacgtggtggcgtacgcaccattcgtcggttacttctacttccttacccgactacgttcg

SEQ ID NO: 441534 - DNA, 517 bp, Homo sapiens
  misc_feature: GZ8MTXP02FVT3Z.11.57.F02.1.454.CMB.2.raw
  modified_base (370)..(370): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccacccaggttcagtggcagtgggtctggggacagacttcattctcnccatccgcagcctagagcctgaagtattttgctagtttattactgtacaacagcgtagcagcaggcctcggcgacgttcgccgaagggaccaaggtcgaagtcgagcgaactgtacggctgcaccatctgtctcactcttccgcatc

SEQ ID NO: 441535 - DNA, 515 bp, Homo sapiens
  misc_feature: GZ8MTXP02I7JS5.11.57.F02.1.454.CMB.2.raw
  modified_base (363)..(363): a, c, t, g, unknown or other
  modified_base (365)..(365): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttagagggccatggcatccaccaggttcagtgcagtgggtctgggacagacttcattcncnccatccgcagcctagagcctgaagatttgctagtttattactgtcaacagcgtagcagcaggcctccgggcgacgttcggccaagggaccaaggtcgaagtcaagcgaaactgtcggactgcacaactctgtctctactctcctccactc

SEQ ID NO: 441536 - DNA, 567 bp, Homo sapiens
  misc_feature: GZ8MTXP02FP08Z.11.57.F02.1.454.CMB.2.raw
  modified_base (369)..(369): a, c, t, g, unknown or other
  modified_base (376)..(376): a, c, t, g, unknown or other
  modified_base (385)..(385): a, c, t, g, unknown or other
  modified_base (440)..(440): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggcccaggctcccaggctcctcatctatgatgcatttaggagggccacgtggcatccccacccaggttcaggtggcaggtgggtctggggacagacttnattctcnccatcccgnagcctaagagccctagaagtattttgctagtttattactgttcaacagacgtagnagcacggcctccgggcgacgttccggaccgaacggggaccgaaaggtggaaagtcgaaggacgaaacgtggtacggcgtcgaccgaccatcctgttccttactacgttcctttcccgcctacttccg

SEQ ID NO: 441537 - DNA, 521 bp, Homo sapiens
  misc_feature: GZ8MTXP02JY0GL.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccggggggtccctgagactctcctgtctagtctctggattcgccttcagtgactatgccatgaagtggtccgccaggctccgaggtaaggggctggaatggatttcatacattagcagtagtggtgcgacatactactacgcagactctgtagaaggccattcatcatctcagagacatgacaacactcactgtatctaggaaatcaacagacctagaagtacggtacgaaggaccgacggctagtaactattagtgtcgacgtagaccgcccccgtaggtcgtaccgg

SEQ ID NO: 441538 - DNA, 522 bp, Homo sapiens
  misc_feature: GZ8MTXP02FLEQ6.11.57.F02.1.454.CMB.2.raw
  modified_base (373)..(373): a, c, t, g, unknown or other
  modified_base (375)..(375): a, c, t, g, unknown or other
  modified_base (417)..(417): a, c, t, g, unknown or other
  modified_base (424)..(424): a, c, t, g, unknown or other
  modified_base (486)..(486): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaaccctggcccaggctcccaggctcctcatctatgatgcatttaggagggccactggcatccccacccaggttcagtggcagtggggtctggggacagacttcattcncnccatccgcagcctagagcctgaagattttgcagtttattacngtcaacngcgtagcagcaggcctccgggcgacgttcggccaagggaccaaggtggaagtcaagcgaacngtggctgcaccatctgtcttcatccttcccgccatc

SEQ ID NO: 441539 - DNA, 517 bp, Homo sapiens
  misc_feature: GZ8MTXP02JWISQ.11.57.F02.1.454.CMB.2.raw
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcaggtcttcgtggctcacgtccaccaccacgcatgtgacctcaggggtccgccaggctccccgaggtaaggggctggaatggatttcatacattagcagtagtggtgcgaccatatactacgcagactctgtgaagggccgattcatcatctcagagacatggcaacaactcactgtatctaggaaactcaacagcctaagagagtcgagacacggctag

SEQ ID NO: 441540 - DNA, 531 bp, Homo sapiens
  misc_feature: GZ8MTXP02IAGPY.11.57.F02.1.454.CMB.2.raw
  modified_base (433)..(433): a, c, t, g, unknown or other
  modified_base (496)..(496): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggtttccttgttgctattttagaaggtgtccagtgcgaggtgcaagtggtgcagtctgggggaggcttaggtccaggccgggggggtccctgagactctcctgtctagtctctggattcgccttcagtgactatgccatgagtggtccgcaggctccgaggtaaggggctggaatggatttcatactattacgcaggtagtggtgcgaccatactactacgcagtactctgtagaggcccgtattccaatctatcctaccagacgacaatggactaanaactacatagtatctaggaatacaacagacctagagtagtcgacggacacggctagtattatnttaagtcgacgtagaccgcccccgtagtcgaccgg

SEQ ID NO: 441541 - DNA, 580 bp, Homo sapiens
  misc_feature: GZ8MTXP02HY93K.11.57.F02.1.454.CMB.2.raw
  modified_base (292)..(292): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctcccagcctccncatctatgatgactagtttaggagggccactggcactccccaaccgtaggttcaggtggcaggtgggtctcggggacagtacttcattcacacctatccgcagcctaggactcctagaagtattttgacttaagtttattactgtacaaacagtcgtaagctagccgacgggtcctccgggacgtacggttcggaacccgaagggaccgaagggtaggaacgtacgaaaggcgaacgtggtacgcgtcaccactactcgtgtcttacactccgttacccgctacgtcg

SEQ ID NO: 441542 - DNA, 548 bp, Homo sapiens
  misc_feature: GZ8MTXP02I3VZW.11.57.F02.1.454.CMB.2.raw
  modified_base (371)..(371): a, c, t, g, unknown or other
  modified_base (520)..(520): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccaggctctcatctatgatgcatttaggagggccacgtggcatccccacccaggttcagtggcagtggggtctgggacagacttcattctcnccatccgcagcctagagcctagagtattttgctagtttattacttgtacaacgagcgtagcagcacggtcccgtcccgggcgtaccgttccggaccgaacggggacccgaaagggtggaaacgtacgaagcgaactggtcggctgcacnctactgtcttcactcctcccgctactcg

SEQ ID NO: 441543 - DNA, 530 bp, Homo sapiens
  misc_feature: GZ8MTXP02GEG6S.11.57.F02.1.454.CMB.2.raw
  modified_base (241)..(241): a, c, t, g, unknown or other
  modified_base (311)..(311): a, c, t, g, unknown or other
  modified_base (352)..(352): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctccctcccgnggctttgtcttggcattatgcacctccacgcccgtccacgtaccagttgaacttgacctcaggtcttcgngctcacgtccaccaccacgcatgtgacctcgacggggtccncaggctccccgaggtaaggggctggaatggatttcatacattagctagtagtgtgcgaccatatactacgcagactcgtgtagaaggccgattacatacatctccaagagacaatggacaaacactcactgtatctagaaactcaacagcctaagagaggtacgaggaacacggatag

SEQ ID NO: 441544 - DNA, 558 bp, Homo sapiens
  misc_feature: GZ8MTXP02HFTIB.11.57.F02.1.454.CMB.2.raw
  modified_base (235)..(235): a, c, t, g, unknown or other
  modified_base (359)..(359): a, c, t, g, unknown or other
  modified_base (366)..(366): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatnttaacaactacttagcctggttccaacagaaacctggccaggctcccaggctcctcatctatgatgcatttaggagggccatggcatcccaccaggttcagtgcagtggtctgggacagacttnattctcnccatccgnagcctagagcctagaagtatttgctagtttattactgtacaacagcgtagcagcacggccgtaccggcgtaccgttccggaccgaaacggggaccaagggtaggaacgtacgaaacggtacgaaacgtggtacggctcggaccaccattcgtaagttctactacttccgttcccgcctacttcg

SEQ ID NO: 441545 - DNA, 565 bp, Homo sapiens
  misc_feature: GZ8MTXP02JRC4U.11.57.F02.1.454.CMB.2.raw
  modified_base (365)..(365): a, c, t, g, unknown or other
  modified_base (367)..(367): a, c, t, g, unknown or other
  modified_base (375)..(375): a, c, t, g, unknown or other
  modified_base (421)..(421): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccatggcatccccaccaggttcagtggcaggtggtctgggacagacttcattcncnccatccgnagcctagacgcctagaagtatttgactagttttatactgtacaacngacgtagacaggcacgggccctccgggcgtacgttccggaccgaagggaccaagggtggaaagtcgaaagtccgaaacgtgtacgggctacggcaacccgatccgttggtccttacgacttcccgttccccgacctatttcccg

SEQ ID NO: 441546 - DNA, 544 bp, Homo sapiens
  misc_feature: GZ8MTXP02HL96N.11.57.F02.1.454.CMB.2.raw
  modified_base (350)..(350): a, c, t, g, unknown or other
  modified_base (368)..(368): a, c, t, g, unknown or other
  modified_base (433)..(433): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggtccaacagaaactggccaggctcccaggctcctcatctatgatgctatttaggagggccagtggcatccccaccaggttcagtgcagtgggtcngggacagacttcatttcncaccatcccgcagcctagacgcctagaagtattttgctagtttattactgtacaacagtcgtagnagcacggcctcggcgtaccgttcggaccgaaggggaccaagggtggaacgtcgaaacgcgaaacgtggacggctcgaccgacatcgtgtcttcactccttcccgctactcg

SEQ ID NO: 441547 - DNA, 576 bp, Homo sapiens
  misc_feature: GZ8MTXP02HC57W.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgctagtttaggagggccacgtggcactccccaccctaggttccaggtggcaggtggggtctggggacagtacttgattctcaccatccgcacgcctagacgccctagaagtattttgctagtttattactgtacaacagtacgtagacagcgacggccgtccgggcgtacggttaccggaccgaaacggggaccgaaagggtcggaaacgtacgaagacggaacgtggtcggcgtacgaccaccatcgtgtcttcgtactccttcccgctacttcg

SEQ ID NO: 441548 - DNA, 627 bp, Homo sapiens
  misc_feature: GZ8MTXP02G1LC5.11.57.F02.1.454.CMB.2.raw
  modified_base (263)..(263): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaanagaaacctggccaggctcccaggctcctcatctatgatgcatttaggagggccatggcatccccaccaggttcagtggcaggtgggtctggggacagacttcattctcacccatcccgcaacgccctagacgccctagtaagtattttgactagttttattactgttacaacagcgtagctagcgagggtccctccgggacggtacggttccggaccgaaacgggggacccaaagggtacgggaaacgtcgaaaacggcggtaaaacgttggtacggtccgttacggaccctaaaccccgtaattacccgtggtttaccctttaccgtacgtttcccctttccccggaccttaacgtttcccgg

SEQ ID NO: 441549 - DNA, 527 bp, Homo sapiens
  misc_feature: GZ8MTXP02I4WJI.11.57.F02.1.454.CMB.2.raw
  modified_base (352)..(352): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggcttttgtcttggcattatgcacctccacgccgtccacgtaccagttgaacttgacctcaggtcttcgtggctcacgtccaccaccacgcatgtcgacctcgacggggtccnccaggctccccgaggtaggggctggaatggattcatacattaccagtagtgtgacgacctatatactacgcagactctgtgaagggcgatcatcatctaccagagacaatcggacaacaactcactgtatctagaaactcaacacgctagaagagtacgaggacacggctagtaa

SEQ ID NO: 441550 - DNA, 512 bp, Homo sapiens
  misc_feature: GZ8MTXP02GGD90.11.57.F02.1.454.CMB.2.raw
  modified_base (286)..(286): a, c, t, g, unknown or other
  modified_base (371)..(371): a, c, t, g, unknown or other
  modified_base (412)..(412): a, c, t, g, unknown or other
  modified_base (462)..(462): a, c, t, g, unknown or other
  modified_base (474)..(474): a, c, t, g, unknown or other
  modified_base (476)..(476): a, c, t, g, unknown or other
  modified_base (479)..(479): a, c, t, g, unknown or other
  modified_base (497)..(497): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggcncctcatctatgatgcatttaggagggccactggcatcccacccaggttcagtggcagtggggtctgggacgagacttcatcttcnccatcgcagcctagagcctgaagattttgcagtttattacngttcaacagtcgagcagcaggcctccggcgacgtcgcagggacctaaggngagacagcgacngngcncgcactatctgtcttacnctccgtcccacactc

SEQ ID NO: 441551 - DNA, 526 bp, Homo sapiens
  misc_feature: GZ8MTXP02HMNHB.11.57.F02.1.454.CMB.2.raw
  modified_base (261)..(261): a, c, t, g, unknown or other
  modified_base (359)..(359): a, c, t, g, unknown or other
  modified_base (380)..(380): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggtccaanagaaactgcagctccagctctcatctatgatgctatttaggaggccactggcatcccacctaggttcagtggcagtggtctgggacagacttcattcncaccatccgcacgcctagacncctagaacgtattttgactagtttattactgttacaacgagcgtagcagcaggtcctcggcgacgtccggacaagggacaaggtgaagtcaaagtcgaacgtgcggctcgacaccgtatctgtcttcacttcgttcccactactcg

SEQ ID NO: 441552 - DNA, 561 bp, Homo sapiens
  misc_feature: GZ8MTXP02F1S94.11.57.F02.1.454.CMB.2.raw
  modified_base (365)..(365): a, c, t, g, unknown or other
  modified_base (367)..(367): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtgcagtgggtctgggacagacttcattcncnccatccgcacgcctagacgcctagaagtattttgacttagttttattactgttacaactagacgtagcagcaggcctccggcgacgttcggaccgaagggaccgaaggtaggaagtcgaaagtcgaaacgtggtacggactcggaccaccataccgtcgttccttacctacttcctttccccgactactttccg

SEQ ID NO: 441553 - DNA, 577 bp, Homo sapiens
  misc_feature: GZ8MTXP02JXL4H.11.57.F02.1.454.CMB.2.raw
  modified_base (370)..(370): a, c, t, g, unknown or other
  modified_base (568)..(568): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaacaactacttagcctggttccaacagaaacctggcccaggctcccaggctcctcatctatgatgcatttaggagggccatggcactcccaccaggttcagtggcagtgggtctgggacagtacttcattcncaccactccgcagcctagactccctagaagttatttgacttagtttattactgtacaaacagcgtagcgagcgacggccgtccgggcgtacggttcggaccgaacgggacccgaaggggtacggaagtacgaagacggtaaacgtggtacggactcggaccacctattccgtcgttcttacacgttccttccccgacncgtttaccg

SEQ ID NO: 441554 - DNA, 552 bp, Homo sapiens
  misc_feature: GZ8MTXP02JG9H1.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggcaggctcccaggctcctcatctatgatgcagtttaggagggccactggcatcccaccaggttcagtgcagtggtctggggacagtacttcattctcaccgatccgcagccctagacgcctagaacgtatttgctagtttattactgtacaacagcgtagcagcacggcctcggacgacgttcggccgaagggaccaagggtaggaagtcgaaaggtacgaaacgtggtcggactcggaccaccctatctgtccttacactccctttcccgcctattccg

SEQ ID NO: 441555 - DNA, 524 bp, Homo sapiens
  misc_feature: GZ8MTXP02I7QX2.11.57.F02.1.454.CMB.2.raw
  modified_base (367)..(367): a, c, t, g, unknown or other
  modified_base (369)..(369): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccaccaggttcagtggcagtgggtctgggacagacttcatttcncnccatccgcacgcctagacgcctagaagtatttgctagtttattactgtacaacagcgtagcagcacggcctaccggcgtacgtcgaccgaagggaccaaaggtggaagtcaagcgaacgtgtggctcgcaccatctgtctcatcctccgctatcg

SEQ ID NO: 441556 - DNA, 558 bp, Homo sapiens
  misc_feature: GZ8MTXP02GHKPO.11.57.F02.1.454.CMB.2.raw
  modified_base (262)..(262): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcatttaggagggccatggcatcccaccaggttcagtgcagtggtctggggacagacttcattcctcaccatcccgacagccctagacgccctagaacgtattttgctagtttattactgtacaacagcgtagcagcacgggcctccgggcgtacgttccggaccgaaggggacccgaaagggtggaaacgtacgaaagacggaaactggtacggctacggactaaccagtctgtcttctactccttcccgcctatcg

SEQ ID NO: 441557 - DNA, 556 bp, Homo sapiens
  misc_feature: GZ8MTXP02GRQ4F.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcagtttaggagggccatggcatcccaccaggttcagtggcaggtgggtctgggacagacttcattctcaccatccgcagcctagacgcctagaagtatttgctagtttatactgtacaacagcgtagacagcacggcctccgggcgaccggttccggaccgaacggggaccgaaagggtggaacgtacgaaaggcgaaacgtggtcgcgtcggaccacgtatctaagttcttacacttccttcccgctacgttcg

SEQ ID NO: 441558 - DNA, 528 bp, Homo sapiens
  misc_feature: GZ8MTXP02HQ3E1.11.57.F02.1.454.CMB.2.raw
  modified_base (329)..(329): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccactggcatccccaccnggttcagtgcagtggtctgggacagacttcattctcaccatccgcagcctagatccctgaagtatttgctagtttattactgtacaactagcgtagcagcaggcctcggcgtacgtcggaccgaagggaccaagggtgaagtcgaaagtcgaaactggtacgctagcaccgtatctgtcttcactccttccgccattcg

SEQ ID NO: 441559 - DNA, 530 bp, Homo sapiens
  misc_feature: GZ8MTXP02GCFSA.11.57.F02.1.454.CMB.2.raw
  modified_base (203)..(203): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggaggccatggcatcccaccaggttcagtgcagtgggtctgggacagacttcattcctcaccatccgcacgcctagagcctagaagtatttgctagtttattactgtacaacagacgtagcagcgacggcctccggcgtacgttcggccgaagggaccgaagggtggaagtcgaagcgaacgtggtacggctgacaccgatctgtcttcactctcccgcactcg

SEQ ID NO: 441560 - DNA, 547 bp, Homo sapiens
  misc_feature: GZ8MTXP02JXLSW.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctggggacagacttcattctcaccatcccgcagcctagacgcctagaagtatttgctagtttattactgtcaacagcgtagcagcaggcctccggcgacgtcgaccgaagggaccgaaggtggaagtacgaaggacgaacgtggtacggcgtcgcgaccatccgtgttaccttctacgttcctttccccgcctacttcg

SEQ ID NO: 441561 - DNA, 608 bp, Homo sapiens
  misc_feature: GZ8MTXP02GNY3H.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttaccaacagaaacctggccaggctcccaggctcctcatctatgatgctatttaggagggccactggcatcccaccaggttcagtggcagtgggtctggggacagacttcattctcaccatccgcagcctagagccctagaagtatttgactagtttattactgttacaaacgtagcgtagcagtccacgggcccttccgggacgaccggtttccgggaccgaaacggggacccgaaagggtacgggaaagtaccgaaaacggtacgtaaacgtggttacggcgtacgaccgaaccgtaataccgtcggttcctttaccaccgttccctttaccccggacccgtaactttccg

SEQ ID NO: 441562 - DNA, 516 bp, Homo sapiens
  misc_feature: GZ8MTXP02HUNKH.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccggggggtccctgagactctcctgtctagtctctggattcgccttcagtgactatgccatgaagtggtccgcaggctccaggtaaggggctggaatggatttcatacattagcagtagtggtgcgacatatactacgcagactctgtgaaggccgatcatcatctacagagacaatggacaaacaactcactagtatactaggaaatacaacagacctagaagacgtacgagacacggactagtatattataagtgacgacgacgaccccgtacggtcgtacg

SEQ ID NO: 441563 - DNA, 558 bp, Homo sapiens
  misc_feature: GZ8MTXP02HOUNL.11.57.F02.1.454.CMB.2.raw
  modified_base (353)..(353): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctccctcccgcggtcttttgtcttggcattatgcacctccacgccgtccacgtaccagttgaacttgacctcaggtctcgtgctcaccgtccaccaccacgcatgtcgacctcgacggggtccnccgaggctcccgagggtagggctaggaatggattcatacattagctagtagtggtgacgacatatactacgacagactcgtgtagaaggcctattcatcatcaccagagacaatcgacaaacaactcaactgtaatcgtaaggaaaactacgaaaacacgacctaaggaacgtacggtacggaaaggacccgacgggtacttaag

SEQ ID NO: 441564 - DNA, 550 bp, Homo sapiens
  misc_feature: GZ8MTXP02G1D2M.11.57.F02.1.454.CMB.2.raw
  modified_base (204)..(204): a, c, t, g, unknown or other
  modified_base (265)..(265): a, c, t, g, unknown or other
  modified_base (290)..(290): a, c, t, g, unknown or other
  modified_base (368)..(368): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaaacaactacttagccttggttccaanagaaacctggccaggctccagctcncatctatgatgcatttaggagggccactggcactcccaccagttcagtggcaggtggtctggggacagacttcattcncaccatccgcagcctagacgcctagaagtatttgactagtttattactgtacaacgagcgtagacagcaggcctcggcgacgtacgaccgaagggaccgaagggtaggaagtcgaaagacgaaacgtggtacggctacggacacctagtctcgttctactacttccttcccgacctattccg

SEQ ID NO: 441565 - DNA, 566 bp, Homo sapiens
  misc_feature: GZ8MTXP02GABPA.11.57.F02.1.454.CMB.2.raw
  modified_base (261)..(261): a, c, t, g, unknown or other
  modified_base (368)..(368): a, c, t, g, unknown or other
  modified_base (386)..(386): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcatttaggagggccacgtggcatcccacccaggttcagtgcagtggtctgggacagacttcattctcnccatccgcagcctagacncctagaagtatttgctagtttatactgtcaacagcgtagcagcacggccctccgggacgtaccgttccggaccgaaaggggacccgaaaggggtacggaaacgtacgaaaggtaccggaaacgtggtcgggactcggaccaccgatctgttccttctacttccgttacccgccagttccg

SEQ ID NO: 441566 - DNA, 552 bp, Homo sapiens
  misc_feature: GZ8MTXP02JI5X5.11.57.F02.1.454.CMB.2.raw
  modified_base (374)..(374): a, c, t, g, unknown or other
  modified_base (394)..(394): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttccagtggcagtgggtctggggacagtacttcattctcnccatcccgcacgcctagacncctgaagtattttgactagtttattactgtacaacagacgtagcagcacggtcctccgggcgtacgttcggccgaaggggaccgaagggtggaaacgtcgaaacggcgaacgtggtacggctgccaccgatctgtcttcacttccgttcccgctatcg

SEQ ID NO: 441567 - DNA, 595 bp, Homo sapiens
  misc_feature: GZ8MTXP02I3CKS.11.57.F02.1.454.CMB.2.raw
  modified_base (235)..(235): a, c, t, g, unknown or other
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatnttaacaactacttagcctggttccaacagaaacctggccaggctccaggctcctcatctatgatgcagtttaggagggccactggcactccccaccaggttcagtggcagtgggtctgggacagacttcattcctcnccatccgcacgcctagacgcctagaagtattttgactagtttattactgtacaacagcgtagacagcgacggtccctccgggcgtaccgttccggaccgaacggggaccgaaagggtcggaaagtacgaaaggacggtaaacgttgggtacgggcttacggccaaccgtacgttccgttcgttcctttacgtactttcccgtttaccccgtacctactttccg

SEQ ID NO: 441568 - DNA, 571 bp, Homo sapiens
  misc_feature: GZ8MTXP02F5YGH.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggttttccttgttgctatttagaaggtgtccagtgcgaggtgcaagtggtgcagtcgtgggggagcttagtccgaggccggggggtcctgagctctcctgtctgtctctggattcgccttcagtgactatgccatgaaggtggtccgcaggctccgaggtaaggggctagggaatgggtatttcaatactattacgctagtagtggtcgacgaccatactactacgcagactctgtgaacgggccatcatcatctaccagagacaagtcggacaaacaacctcactagtactacgtaggaaactaccaaactacgacctaggaacgtaacggtaccggaacgggacaccgggtcttacggttaatagtttaatggtacgacggaacgacccgtacccccgtagggtacgtaacccgg

SEQ ID NO: 441569 - DNA, 586 bp, Homo sapiens
  misc_feature: GZ8MTXP02IA178.11.57.F02.1.454.CMB.2.raw
  modified_base (204)..(204): a, c, t, g, unknown or other
  modified_base (365)..(365): a, c, t, g, unknown or other
  modified_base (385)..(385): a, c, t, g, unknown or other
  modified_base (421)..(421): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtcaaaatattaacaactattagcctggttccaacagaaacctggccaggctcccaggcctcctcatcatgatgcatttaggagggccatggcatccccaccaggttcagtgcaggtggtctgggacagacttcatttcncaccatccgcagccctagancctgaagtattttgctagtttattactgtactaacngacgtagcagcgaggcctccgggcgtacgttcgggaccgaaggggacccgaagggtacggaagtacgaaaggaccgaaacgttggtacggtcgtacggaccgaccctaattccgttaacggttctttaccgtacgtttccctttacccccggccttaacttcccg

SEQ ID NO: 441570 - DNA, 574 bp, Homo sapiens
  misc_feature: GZ8MTXP02IDC7S.11.57.F02.1.454.CMB.2.raw
  modified_base (203)..(203): a, c, t, g, unknown or other
  modified_base (371)..(371): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtcaaaatattaacaactacttagcctggttccaacagaaacctggccaggctccaggctcctcatctatgatgcatttaggagggccacgtggcatccccacccagggttcagtggcaggtggtctggggacagacttcatttccncaccatccgcagccctaggatccctagaagattttgactagtttattactgttacaacgagcgtaagcagtccgacggtccctaccggcggtaccgtttcgcgaccgaaggggaccctaaaggggtcgaaagtaccgaaaaggcgtaaactggtcggactggcctaccgatcgtcgtacttctactcccgtttccgacctacg

SEQ ID NO: 441571 - DNA, 579 bp, Homo sapiens
  misc_feature: GZ8MTXP02GFDF3.11.57.F02.1.454.CMB.2.raw
  modified_base (204)..(204): a, c, t, g, unknown or other
  modified_base (385)..(385): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttaccaacagaaaccctggcccaggctcccaggctcctcatctatgatgactatttaggagggtccacgtggccactccccacccgtagggttccaggtggcaggtgggtctgggacagacttcattccncaccatccgcacgcctagacgcctagaagtatttgctagtttattactgtacaacagtacgtagcagcacggccgtccggaggtaccccccgttggacccgaacggggtaccgaaagggtaggaagtacgaacgacgtaacgtggtcggctacggccaacctatactgtcttactactcctcccgcctacttcg

SEQ ID NO: 441572 - DNA, 527 bp, Homo sapiens
  misc_feature: GZ8MTXP02JW8TO.11.57.F02.1.454.CMB.2.raw
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttcagtggcagtgggtctggggacagacttcattctcnccatccgcagcctagagccctagaagtatttgctagtttattactgtacaacagcgtagcagcaggcctccggcgacgttcggccgaagggaccaagggtggaagtcaagcgaacgtgcggctgcaccatctgtcttcacttcctcccgcactcg

SEQ ID NO: 441573 - DNA, 594 bp, Homo sapiens
  misc_feature: GZ8MTXP02G5ADM.11.57.F02.1.454.CMB.2.raw
  modified_base (367)..(367): a, c, t, g, unknown or other
  modified_base (369)..(369): a, c, t, g, unknown or other
  modified_base (387)..(387): a, c, t, g, unknown or other
  modified_base (429)..(429): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggtccactggcatcccaccaggttcagtgcagtggtctggggacagacttcattcncnccatccgcagcctagacncctagaacgtatttgctagtttattactgtacaacagcgtancgtagcacggtcctcgggcggtaccgttccggaccgaaaggggacctaaaggggtacggaaacgtacgaaaggtacggaaacgttggtacgggcttacggcccgaacctagttccgttaacggttcttaccgtacttccccgtttaccccggcctaactttcccg

SEQ ID NO: 441574 - DNA, 530 bp, Homo sapiens
  misc_feature: GZ8MTXP02JRI94.11.57.F02.1.454.CMB.2.raw
  modified_base (262)..(262): a, c, t, g, unknown or other
  modified_base (368)..(368): a, c, t, g, unknown or other
  modified_base (470)..(470): a, c, t, g, unknown or other
  modified_base (503)..(503): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaanagaaacctggccaggctcccaggctcctcatctatgatgctatttaggaggccactggcatccccaccagttcagtggcagtgggtctggggacagacttcattcncaccgatccgcagccctagacgcctagaagtattttgactagtttattactgtacaacagcgtagcagcaggcctccggcgacgtcgcgaagggacgaaggnggaagtcgaagcgaacgtggtcggctcgcaccntactgttctctactcctcccgcctatc

SEQ ID NO: 441575 - DNA, 520 bp, Homo sapiens
  misc_feature: GZ8MTXP02IMJC4.11.57.F02.1.454.CMB.2.raw
  modified_base (373)..(373): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttaggtccaggccgggggggtccctgagactctcctgtctagtctctggattcgccttcagtgactatgccatgaagtggtccgcaggctccgaggtaaggggctggatggatttcatacattagcagtagtggtgcgacatatactacgnagactctgtagaagggccgtatcatcatctaccagagacaatgacaaacaactcactgtatcgtagaatacgaacagacctgaagacgtacggaggacaccggctagtattattattgtgacgacgacgcccccgtaggtcgaccgg

SEQ ID NO: 441576 - DNA, 562 bp, Homo sapiens
  misc_feature: GZ8MTXP02HKK9Q.11.57.F02.1.454.CMB.2.raw
  modified_base (373)..(373): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcacctctcctgcagggccagtcaaaatattaacaactacttagcctggttccaacagaaacctggccaggctcccaggctcctcatctatgatgctagtttaggagggccactggcactcccaccaggttcagtggcagtgggtctggggacagcttcattctcaccntccgcagcctaggacgccctagaagtacttttgactagttttatactgtacaacagtacgtagcagcacggtccgtcggcgtacggttccggaccgtaacggggaccgaagggtaggaacgtcgaaaggacgaacgtggtacggctacgccacgtatcgtcgttcttacacgttccttcccgctactcg

SEQ ID NO: 441577 - DNA, 586 bp, Homo sapiens
  misc_feature: GZ8MTXP02JAQRK.11.57.F02.1.454.CMB.2.raw
  modified_base (366)..(366): a, c, t, g, unknown or other
  modified_base (385)..(385): a, c, t, g, unknown or other
  modified_base (420)..(420): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaatattaacaactacttagcctggttccaacagaaacctggccaggctcccaggctcctcatctatgatgcatttaggagggccatggcatcccaccaggttcagtgcaggtggtctgggacagacttcattcctcnccatcccgcagcctagacncctagaagtatttgctagtttattactgtacaacngcgtagcagcaggcccgtccggacgtaccggttccggaccgaaaggggacccgaaagggtggtaaacggtaccgaaaggaccggaaacgttcggtcgggactacggcctaaaccgacttcgtaacggttccttacgtacttcccttccccggtaccctatttaccg

SEQ ID NO: 441578 - DNA, 539 bp, Homo sapiens
  misc_feature: GZ8MTXP02HQYVZ.11.57.F02.1.454.CMB.2.raw
  modified_base (240)..(240): a, c, t, g, unknown or other
  modified_base (350)..(350): a, c, t, g, unknown or other
  modified_base (461)..(461): a, c, t, g, unknown or other
  modified_base (505)..(505): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgngctttgcttggcattatgcacctccacgccgtccacgtaccagttgaacttgacctcagggtcttcgtgctcacgtccaccaccacgcatgtcgacctcgaggggtcccnccaggcctacccgagggtaggggctaggaatggatttcatacattagcagtagtggtgcgacatatactacgcagactctgtagaagggccgtattcattcatctccaganaacaatcggacaacaactacactgttatcgtagaaactcaaacngcctaagagacgtacgaggacgacggtacttaag

SEQ ID NO: 441579 - DNA, 548 bp, Homo sapiens
  misc_feature: GZ8MTXP02GOFZ3.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccatggcatccaccaggttcagtgcagtggtctggacagacttcattctcaccatccgcagcctagacgcctgaagtattttgctagtttattacgtgtcaacagcgtagcagcacggcctccgggacgaccgttcggaccgaacgggaccgaaggtggaagtcaacgacgaaacgtgtcggcgtgaccgacctaacttctcgttacttactacttcctttccccgacctactttcg

SEQ ID NO: 441580 - DNA, 582 bp, Homo sapiens
  misc_feature: GZ8MTXP02FPM2Q.11.57.F02.1.454.CMB.2.raw
  modified_base (367)..(367): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtgcagtgggtctgggacagacttcattctcnccatcccgcacgccctaggacgcctagaagtattttgctagtttattactgtacaaacagagtagacagcacggcctccggacgtaagttccggaccgaaaggggaccaaagggtcggaaagtcgaaaggtacgaaacgtggtacggtacgtacgaccgaacccgtaattccgtaacgttcttacgtacttccctttaccccgcctaactttccg

SEQ ID NO: 441581 - DNA, 562 bp, Homo sapiens
  misc_feature: GZ8MTXP02I5L9L.11.57.F02.1.454.CMB.2.raw
  modified_base (289)..(289): a, c, t, g, unknown or other
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccaggctccncatctatgatgcagtttaggagggccacgtggcactccccacctaggttcagtggcagtgggtctggggacagacttcattcncaccatccgcacgcctaggacgcctagaaagtattttgacttagtttattactgtacaacagcgtagcagcgacggccgtccgggacgtacgtcggaccgaacgggaccgaagggtggaagtacgaagacgaacgtggtcggctacgaccaccgtatcgtcgtccttactacttcctcccgactacttcg

SEQ ID NO: 441582 - DNA, 533 bp, Homo sapiens
  misc_feature: GZ8MTXP02G3G0Z.11.57.F02.1.454.CMB.2.raw
  modified_base (349)..(349): a, c, t, g, unknown or other
  modified_base (430)..(430): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacatggtacgtgctgttgtactgctcctcccgcggctttgtcttggcattatgcacctccacgcctccacgtaccagttgaacttgacctcagggtctcgtggctcacgtccaccaccacgcatgtcgacctcgaggggtccnccaggccctccgaggtaacgggctaggaatggatttcatacattagcagtagtgtgacgaccatactactacgcagactcngtgaagggcctattcatcatctaccagagacaagtcgacaaacaacctcgacttagtactcgaggaaactccgaatacgcctagagagtccgagacgacggtc

SEQ ID NO: 441583 - DNA, 521 bp, Homo sapiens
  misc_feature: GZ8MTXP02IX36R.11.57.F02.1.454.CMB.2.raw
  modified_base (381)..(381): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccaggccggggggtccctgagactctcctgtctagtctctggattcgccttcagtgactatcgccatggaagtgggtccgccaggcctccgaggtaaggggctagggaatggatttcatacatagcagtagtggtgcgacatatactacgcanactctgtagaggccgatcatcatctcagagacaataggacaaacactacactgtactcgtaggaaactacaacagacctgagacgtcgaggacacggctagtatattatgtgacgacgaccgccccgtacggacgtacgg

SEQ ID NO: 441584 - DNA, 581 bp, Homo sapiens
  misc_feature: GZ8MTXP02HQMDR.11.57.F02.1.454.CMB.2.raw
  modified_base (264)..(264): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaanagaaacctgcaggctcccaggctcctcatctatgatgctagtttaggagggccacgtggaccactccccaccgtaggttcaggtcggctaggtggggtctcggggacagtacttcatttccacacctatcccgcacgcctagacgtcctagaagtatttgacttagtttattactgtacaacgagtcgtagcagcgacggtcccgtccgggcgtacgttccggaccgaaggggaccgaagggcggaagtcgaaaggacgtaacgtggcggactcgaccacctatcgtgtcttacgtacttccttcccgactattccg

SEQ ID NO: 441585 - DNA, 524 bp, Homo sapiens
  misc_feature: GZ8MTXP02G0JOS.11.57.F02.1.454.CMB.2.raw
  modified_base (204)..(204): a, c, t, g, unknown or other
  modified_base (235)..(235): a, c, t, g, unknown or other
  modified_base (310)..(310): a, c, t, g, unknown or other
  modified_base (365)..(365): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatnttaacaactacttagcctggttccaacagaaacctggccaggctcccaggctcctcatctatgatgcatttaggnggccatggcatcccaccaggttcagtggcagtgggtctgggacagacttcattcncaccatccgcagcctagacgcctagaagtatttgctagtttattactgtacaactagcgtagcagcaggcctccggcgacgttcggcgaacgggaccaaggtggaagtcgaagtcgaactggtcgctcgcaccatctgtcttcactccttcccgctatc

SEQ ID NO: 441586 - DNA, 636 bp, Homo sapiens
  misc_feature: GZ8MTXP02I0LLB.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctccaggctcctcatctatgatgcagtttaggagggccacgtggcactcccaccaggttcagtggcagtgggtctggggacagtacttcattcctcaccatcccgacacgcctaagacgtcctagaaagtattttgactaagtttattactgttacaacgagaccgtagcgagcgaacggtccctccgggacgtacggttccggaccggtaaacgggaaccggaaagggttacggggaaacgtacgaaaacggtaccgtaaaacgtcggttacgggacgttcgaccgaaacctacgttccgttaacggttccgtttaccgtaactttcccggtttacccccgaccgtaactttaccgg

SEQ ID NO: 441587 - DNA, 519 bp, Homo sapiens
  misc_feature: GZ8MTXP02I5K0W.11.57.F02.1.454.CMB.2.raw
  modified_base (325)..(325): a, c, t, g, unknown or other
  modified_base (369)..(369): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatataacaactacttagcctggttccaacagaaacctggccaggctcccaggctcctcatctatgatgcatttaggagggccatggcatcccnccaggttcagtgcagtggtctggggacagacttcattctcaccntccgcagcctagacgcctagaaagtattttgctagtttattactgtacaactagcgtagcagcaggcctcggcgacgttcgcgaagggaccaaggtggaagtcgaagcgaacgtgtacggctgcaccatctgtctcactcctccgcatcg

SEQ ID NO: 441588 - DNA, 534 bp, Homo sapiens
  misc_feature: GZ8MTXP02I70H3.11.57.F02.1.454.CMB.2.raw
  modified_base (203)..(203): a, c, t, g, unknown or other
  modified_base (234)..(234): a, c, t, g, unknown or other
  modified_base (375)..(375): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatnttaacaactacttagcctggttccaacagaaacctggccaggctcccaggctcctcatctatgatgcatttaggaggccagtggcatcccaccaggttcagtgcagtggtctgggacagacttcattcctcaccatcccgnagcctaagacgcctagaagtatttgctagtttattactgtcaacagcgtagctagcaggcctccgggcgacgttcggaccaaggggaccaaagggtggaaagtcgaaaggcgaaacgtggtaggctcgcacgatctgtctacactcttcccgctattcg

SEQ ID NO: 441589 - DNA, 513 bp, Homo sapiens
  misc_feature: GZ8MTXP02F0JY9.11.57.F02.1.454.CMB.2.raw
  modified_base (446)..(446): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttcagtgactatgccatgaagtgggtccgcaggctccgaggtaagggctggaatggtatttcatacattagcagtagtggtgcgacatatactacgcagactctgtgaggccgattcatcatctccagagacaatggacaaacaactcactgtactctaggaaatcaaacngacctagagagtacggagacacggactgtaatattatgtagacgacgacgcccccgtaggcgtacgg

SEQ ID NO: 441590 - DNA, 637 bp, Homo sapiens
  misc_feature: GZ8MTXP02FOEVP.11.57.F02.1.454.CMB.2.raw
  modified_base (264)..(264): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatattaacaactacttagcctggttccaanagaaacctgccaggctcccaggctcctcatctatgatgctatttaggagggccacgtggcactccccaccaggttcaggtgcaggtgggtctgggacagacttcattcctcaccatcccgcacgccctaagacgccctagaacgttatttgactagttttattactgtacaacagacgtagacagcgacggtcccgtccgggacgtacgttcctacggacccgtaaaggggaacccgaagggttacggaaacgtacgaaaacggaccggtaaaaccgttgggttacgggaccgttacggtaacccaacccttaacgttccgttcggttaacctttcccgtaactttccccgtttacccccggcctttaaaccg

SEQ ID NO: 441591 - DNA, 577 bp, Homo sapiens
  misc_feature: GZ8MTXP02G94NW.11.57.F02.1.454.CMB.2.raw
  modified_base (374)..(374): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccgaggccgggggggtcctgagactctcctgtctagtctctggattcgccttcagtgactatcgccagtgaaggtcgggtccgccaggcctccgagggtaaggggctagggaatggtatttcatacattacgcagtagtggtgcgacntactactacgcagactctggtagaacggggcccgtattcgatcatcctaccgaagagacaagtaggaccaaacactcacttgtactcaggaaactacgaaacacgtacctagagacgtacggacggacacgggtactagttaattacgtttaagttggtacgaccggtaacggaccgtacccccgtacggtacgtaacccggg

SEQ ID NO: 441592 - DNA, 522 bp, Homo sapiens
  misc_feature: GZ8MTXP02FH3W8.11.57.F02.1.454.CMB.2.raw
  modified_base (414)..(414): a, c, t, g, unknown or other
  modified_base (421)..(421): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccccaggttcagtggcagtgggtctgggacagacttcattctcaccatccgcagcctagagcctgaagattttgctagtttattacngtcaacngcgtagcagcaggcctccggcgacgttcggccaagggaccaaggtggaagtcaaagcgaaacgtgtcgctcgcaccatctgtcttcactccttcccgcatc

SEQ ID NO: 441593 - DNA, 552 bp, Homo sapiens
  misc_feature: GZ8MTXP02GDXYZ.11.57.F02.1.454.CMB.2.raw
  modified_base (261)..(261): a, c, t, g, unknown or other
  modified_base (355)..(355): a, c, t, g, unknown or other
  modified_base (438)..(438): a, c, t, g, unknown or other
  modified_base (445)..(445): a, c, t, g, unknown or other
  modified_base (476)..(476): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggcgtttgttggagaccttgcacttgtactccttgccattcagccagtcctggtgcaggacggtgaggacgctgaccacacggtacgtgctgttgtactgcctcctccgcggtcttttgtcttggcattangcacctccacgccgtccacgtaccagttcgaacttgacctcgagggtctcgtgctcacgtccaccacacgcatgtcgacctcgacggggtcccncgaggcctacccgaggggtaacggggctagggaatggactttcatacattagctaagtagtggtgacgaccataactactacncagactntagagaagggccattcagtcatctacaaganacagcgacaaacactcgactatactacgtaagaaactacaacacgacgaagagacgacgacggacgacgtacgtag

SEQ ID NO: 441594 - DNA, 544 bp, Homo sapiens
  misc_feature: GZ8MTXP02IIUKL.11.57.F02.1.454.CMB.2.raw
  modified_base (349)..(349): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggttttccttgttgctattttagaaggtgtccagtgcgaggtgcaagtggtgcagtcgtgggggagcttagtccaggccggggggtcctgagactctcctgtctagtctctggattcgccttcagtgactatgccatgagtggccgcaggctccgaggtaagggcaggaatggatttcatacattacgcagtagngtgcgacatatactacgacagactctgtgaagggccgtatcatcatcctaccagaacgacaaagtggacaaacaactacactacgtaatcgtaagaaactacaaacacgacctagaacgtacggtacgacggaacacggtactagttacttattagttgtagacggacgaccgtaccccgtacggttacgaccgg

SEQ ID NO: 441595 - DNA, 608 bp, Homo sapiens
  misc_feature: GZ8MTXP02FRHJ7.11.57.F02.1.454.CMB.2.raw
  modified_base (308)..(308): a, c, t, g, unknown or other
  modified_base (362)..(362): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccagctctcatctatgatgcatttaggngggccactggcatcccaccagttcagtgcagtggtctgggacagacttcattcncaccgatcccgnacgcctagacgtccctagaaagtattttgacttaagtttattactgtacaaacgtagacgtagacgagcgacgggcccgtacccgggacgaccggttaccgggacccgaaacggggaacccgtaaaggggtaggaaaacggtcgaaaaggtacgtaacgtaggtacggcgttacggccgaacccagttacctcggttccttactacttcccgtttacccggaccctagtttccg

SEQ ID NO: 441596 - DNA, 561 bp, Homo sapiens
  misc_feature: GZ8MTXP02JVSIH.11.57.F02.1.454.CMB.2.raw
  modified_base (356)..(356): a, c, t, g, unknown or other
  modified_base (430)..(430): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccagtggcatcccacccaggttcagtggcaggtggtctgggacngtacttcattctcaccatccgcagcctagacgcctagaagtatttgactagtttatactgtacaacagcgtaancagccgaggcccgtccgggcgtacggttccggaccgaaaggggacccgtaagggtaggaacgtacgaaggacgaaactggtacggctacgccacctagtcctaagtccttacacttccgtcccgctatccg

SEQ ID NO: 441597 - DNA, 538 bp, Homo sapiens
  misc_feature: GZ8MTXP02HAU34.11.57.F02.1.454.CMB.2.raw
  modified_base (362)..(362): a, c, t, g, unknown or other
  modified_base (367)..(367): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttaccaacagaaacctggccaggctcccaggctcctcatctatgatgcatttaggaggccatggcatcccaccaggttcagtggcagtgggtctgggacagacttnattcncaccatccgcagcctagacgccctagaaagtattttgctagttttattactgtacaaacagcgtagcagcaggcctccggcgacgttcggaccgaagggaaccgaaggtaggaacgacgaagcgaaactggtaggcctagcaccatctgtactcactcttcccgcctatcg

SEQ ID NO: 441598 - DNA, 567 bp, Homo sapiens
  misc_feature: GZ8MTXP02H2VNP.11.57.F02.1.454.CMB.2.raw
  modified_base (202)..(202): a, c, t, g, unknown or other
  modified_base (289)..(289): a, c, t, g, unknown or other
  modified_base (376)..(376): a, c, t, g, unknown or other
  modified_base (537)..(537): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctccagataccaccggagaaattgtgttgacacagtctccggccaccctgtctgcgtctcctggggaaacngtcaccctctcctgcagggccagtacaaaatattaaacaactacttagcctggttcaaacagaaacctggccaggctcccagctccncatcatgatgctagtttaggagggccactggcactccccacccagggttcaggtggcaggtgggtctggggacagtacttcatttcncaccatccgcacgcctaagacgtcctagaaagtattttgctaagtttatttactgtacaaacagtcgtaagcagcgacggtccgtccggcgtacggttcggaccgaaacggggaccgaagggtacgaagcaaagcgaaacgttggacgcgtcgaccacctntcgtgtctactactcctcccgactacgtcg

SEQ ID NO: 441599 - DNA, 537 bp, Homo sapiens
  misc_feature: GZ8MTXP02HWM2F.11.57.F02.1.454.CMB.2.raw
  modified_base (236)..(236): a, c, t, g, unknown or other
  modified_base (296)..(296): a, c, t, g, unknown or other
  modified_base (305)..(305): a, c, t, g, unknown or other
  modified_base (330)..(330): a, c, t, g, unknown or other
  modified_base (345)..(345): a, c, t, g, unknown or other
tcagcgagagataccacgaccggtgctcgatttagctcgatatagttgggtttggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtactgctgttgtactgctcctccgnggctttgtcttggctattatgcacctccacgccgtccacgtaccagttgaacttgacctnaggtctcgngctcacgtccaccaccacgcatgtnacctcgaggggtccnccaggctcccgaggtagggctaggaatggatttcatacattagctagtagtggtgcgaccatactactacgcagactcgtaggtagaaggggcctaattcaattcatctaccagacgacaatggacaacaactcactgtatctaggaaactcaaactagcctaagaacgacgtacgaggaccacggtactag

SEQ ID NO: 441600 - DNA, 602 bp, Homo sapiens
  misc_feature: GZ8MTXP02ICN6D.11.57.F02.1.454.CMB.2.raw
  modified_base (205)..(205): a, c, t, g, unknown or other
  modified_base (264)..(264): a, c, t, g, unknown or other
  modified_base (389)..(389): a, c, t, g, unknown or other
  modified_base (424)..(424): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccggccaccctgtctgcgtctccgtggggaaacngtcaccctctcctgcagggccagtacaaaatattaacaactacttagcctggtaccaanagaacctggccaggctcccaggcctcctcatctatgatgactagtttaggacgggccacgtggaccactcccccaaccgtagggttcaggtggcgagggtgggtctggggacagtacttcattcncaccatcccgcacgccctagacgtccctagaagtnttttgacttagtttattactagtacaacgagtcgtagcacgcgacggtcccgtacgggcgtaccggttcggaccgtaaagggaccgaagggtggaaagtacgaaacggtacgaacgtggtacggtcgtacgaccaccgtagtcgtcgttacttctacttccctcccgtactacgtccg

SEQ ID NO: 441601 - DNA, 542 bp, Homo sapiens
  misc_feature: GZ8MTXP02G2VSU.11.57.F02.1.454.CMB.2.raw
  modified_base (478)..(478): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaatattaacaactacttagcctggttccaacagaacctgccaggctccaggctctcatctatgatgcagtttaggagggccagtggcactcccaccaggttcagtggcaggtgggtctgggacagtactcattctcaccatccgcagccctaagcgtccctagaacgtattttgacttagtttacttactgtactaacagcgtagacagcacggtcctcggcgacgttcgaccgaagggaccgaaggngaagtcgaagcgaacgtggtcgacgtgacctacgatctgtcttctactccttcccgctacgttc

SEQ ID NO: 441602 - DNA, 650 bp, Homo sapiens
  misc_feature: GZ8MTXP02JWGUN.11.57.F02.1.454.CMB.2.raw
  modified_base (205)..(205): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctcctggggaaacngtccaccctctcctgcagggccagtcaaaatattaacaactacttagcctggttccaacagaaacctggccaggctcccaggctcctcatctatgatgctagtttaggacgggccacgtggcactccccaacccgaggttcaggtggctaggtggggtctcggggactagtacttcacttcctacaccacgtcccgacacgtccctaggacgtcctagaaagttattttgacttaagttttacttacgtagttaccaaacgaggtacgtaacgcgacgacgtacgggtcccgttaccgggcggtaaccggttacccgggaccgaaacgggggtacccgaagggtacgggaagtaccgaaaggtacggtaaacgtggtacggacgtacgaccgacctacgttccgttcgtctttaccacgttccctttccccggacctacgttccg

SEQ ID NO: 441603 - DNA, 582 bp, Homo sapiens
  misc_feature: GZ8MTXP02JZEJF.11.57.F02.1.454.CMB.2.raw
  modified_base (290)..(290): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctccncatctatgatgcagtttaggagggccacgtggcactccccacccaggttccagtggcaggtggggtctggggacagacttcattctcaccagtccgcagcctagacgcctagtaaacgtattttcgctagtttattactgtacaacgtagcgtagcagcgacggcctcggacgtacgttccggaccgaacggggaccgaagggtcggaaacgtacgaaaggcgtaaacgtggtcggacctcggacctaccgtattcgtaacgttcttacgacttcccgtcccgtacacttcg

SEQ ID NO: 441604 - DNA, 608 bp, Homo sapiens
  misc_feature: GZ8MTXP02G69I0.11.57.F02.1.454.CMB.2.raw
  modified_base (292)..(292): a, c, t, g, unknown or other
  modified_base (356)..(356): a, c, t, g, unknown or other
  modified_base (374)..(374): a, c, t, g, unknown or other
  modified_base (384)..(384): a, c, t, g, unknown or other
  modified_base (433)..(433): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtcaaaatattaaacaactacttagcctggttaccaacagaaacctggccaggctcccagctccncatctatgatgctagtttaggagggccactggcactccccaccaggttcagtgcaggtgggtcngggacagacttcattccncaccatccgnacgcctagacgctagaagttatttgactagtttaattactgtacaaacngacgttagacagcgacggtccgtcccgggaccgtacggttccggaccggaaacggggaacccgtaaagggtacggaaacggtacgaaaacgaccggtaaacgtgggtacggcgtacgcctaaccgacttccgttcgttccttacctacttcccctttccccggacctacttaccg

SEQ ID NO: 441605 - DNA, 540 bp, Homo sapiens
  misc_feature: GZ8MTXP02FP7HL.11.57.F02.1.454.CMB.2.raw
  modified_base (204)..(204): a, c, t, g, unknown or other
  modified_base (368)..(368): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccatggcatccccaccaggttcagtgcagtgggtctggggacagacttcattccncaccatccgcagcctagacgcctagaagtattttgctagtttattactgtacaacagacgtagcagcaggccctcgggcgacgttccggacaacgggaccaaggtggaagtcaaaggtacgaacgtggtacggctgccaccgatctgtacttcacgtccttcccgctactcg

SEQ ID NO: 441606 - DNA, 552 bp, Homo sapiens
  misc_feature: GZ8MTXP02HD3KK.11.57.F02.1.454.CMB.2.raw
  modified_base (366)..(366): a, c, t, g, unknown or other
  modified_base (525)..(525): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccaccaggttcagtgcagtgggtctgggacagacttcattctcnccatccgcagcctagacgcctagaacgtattttgacttagtttaattactagtacaaacagtcgtagacagcagggccctaccgggcgtaccgttccggaccgaaggggaacccaagggtggaaacggtacaaggcgaacgtggtggactcgcaaccgnttctgtctctactccgtccgctactcg

SEQ ID NO: 441607 - DNA, 628 bp, Homo sapiens
  misc_feature: GZ8MTXP02G6P66.11.57.F02.1.454.CMB.2.raw
  modified_base (205)..(205): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtcaccctctcctgcagggccagtacaaaatattaacaactacttagcctggttccaacagaaacctggccaggctccaggctcctcatctatgatgctagtttaggagggccacgtggcactccccacccgaggttcaggtcggcaggtggggtctcggggacagtacttcattctcacctactccgcacgcctagagcctagaatatttgctagtttattactgtacaacgtagacgtagacagacgacggtccgtcccgggaccgggtaccggtttcccgggacccggaaacggggacccgtaaagggggtcggaaacggtacgaaaacggaccggtaaacgttgggtacggtcgttcggacctaacccgtattcccttggttccttacctacgttacccttcccggtacctactaccgg

SEQ ID NO: 441608 - DNA, 527 bp, Homo sapiens
  misc_feature: GZ8MTXP02JHJSS.11.57.F02.1.454.CMB.2.raw
  modified_base (362)..(362): a, c, t, g, unknown or other
  modified_base (443)..(443): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccaggccggggggtccctgagactctcctgtctagtctctggattcgccttcagtgactatgccatgagtggtccgccaggctccgaggtaagggctggaatggatttcatacattagcagtagtggtgcgacntatactacgcagactctgtgaggccgattcatcatctcagagacagtcggacaaacactcactgtatcgtagaaatcaacngacctagagtacgtacgacggacgacggtactagttaactatttatgtcgtacgacggaccgacccccgttaggtacgtaccgg

SEQ ID NO: 441609 - DNA, 573 bp, Homo sapiens
  misc_feature: GZ8MTXP02FIMDB.11.57.F02.1.454.CMB.2.raw
  modified_base (372)..(372): a, c, t, g, unknown or other
  modified_base (375)..(375): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctgcaggctccaggctcctcatctatgatgctatttaggagggccactggcactccccacccaggtcagtggcgagtgggtcgtcgggacagacgttcattctcnccnctaaaaaaccgcacgcctagagcctagtaagtattttgactagtttaacttactacgtacaacagtacgtagacgagcgacggccgtccgggccggtaccggttaccggaccgaacgggaccgaacggtacggaagtacgaagacgaacgtgtggctcgcaccgactactcgtcttcgtactcctcccgcctactacg

SEQ ID NO: 441610 - DNA, 643 bp, Homo sapiens
  misc_feature: GZ8MTXP02JXSBO.11.57.F02.1.454.CMB.2.raw
  modified_base (291)..(291): a, c, t, g, unknown or other
  modified_base (369)..(369): a, c, t, g, unknown or other
  modified_base (371)..(371): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctnatctatgatgcatttaggagggccagtggcactcccacccaggttcaggtggcagtggtctgggacagacttcattcncnccatccgcagtcctagacgtccctagaaagtattttgacttagtttattaacgtcgtactaacgtagcgttaagccgagaccgacgggtacccgtcccgggacggtacccggtttcgggacccgaaacggggaccgtaaacggggtcgggaaacgtacgaaacggacggtaaacgttggtacgggtaccttcggaccgaacccgtaagttacccgttcggtttacctttaccgtaaccgtttccctttcccccggtaccttaacgtttcccg

SEQ ID NO: 441611 - DNA, 579 bp, Homo sapiens
  misc_feature: GZ8MTXP02IUAR9.11.57.F02.1.454.CMB.2.raw
  modified_base (372)..(372): a, c, t, g, unknown or other
  modified_base (429)..(429): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtcaaaatattaacaactacttagcctggttccaacagaaacctggcccaggctcccaggctcctcatctatgatgcagtttaggagggccactggcatcccaccaggttcagtgcaggtggtctgggacagacttcattcctcnccatcccgcacgcctagacgtcctagaagtatttgactagtttattactagtcaacngacgtagcagcacggccgtccggcgtaccgttcggaccgtaaagggaccaaagggttaggaacgtacgaacggtacgaaacgttggtacgcgtacggacctaccgtattccgttaagtccttactacgttcctccccggtacctacttcg

SEQ ID NO: 441612 - DNA, 502 bp, Homo sapiens
  misc_feature: GZ8MTXP02HCZA0.11.57.F02.1.454.CMB.2.raw
  modified_base (443)..(443): a, c, t, g, unknown or other
  modified_base (497)..(497): a, c, t, g, unknown or other
tcagcgagagataccacgaccggtgctcgatttagctcgatatagttgggtttggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccggggggtccctgagactctcctgtctagtctctggattcgccttcagtgactatgccatgaagtggtccgccaggctccaggtaaggggctgggaatggatttcatacattagcagtagtgtgcgacatatactacgcagactctgtagaaggccgattcatcatctcagagacaatgacaacaactcactgtatctaggaaatcaaacncgactgagtagcgaggacaggactgtactattatgtgcgagacgccctacggtnaccgg

SEQ ID NO: 441613 - DNA, 518 bp, Homo sapiens
  misc_feature: GZ8MTXP02GM1YP.11.57.F02.1.454.CMB.2.raw
  modified_base (310)..(310): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgcatttaggngggccatggcatcccaccaggttcagtgcagtgggtctgggacagacttcattctcaccatcccgcagtcctaagacgtccctagaagtattttgctagtttattactgtcaacagctagcagcagcctcggcgacgtcggacgaagggacaaggtgaagtcgaaagcgaactgtgctgcacatctgtcttcacttcctccgcctatc

SEQ ID NO: 441614 - DNA, 576 bp, Homo sapiens
  misc_feature: GZ8MTXP02H6QUA.11.57.F02.1.454.CMB.2.raw
  modified_base (311)..(311): a, c, t, g, unknown or other
  modified_base (427)..(427): a, c, t, g, unknown or other
tcagcgagagataccacgaccggtgctcgatttagctcgatatagttgggtttgggggaggaactgctcagttaggacccagagggaaccatggaagccacagctcagcttctcttcctcctgctactctggctcccagataccaccggagaaattgtgttgacacagtctccggccaccctgtctgcgtctcctgggaaacagtcaccctctcctgcagggccagtcaaaatattaacaactacttagcctggttaccaacagaaacctggccaggctcccaggctcctcatctatgatgcatttagggnggccactggcatccccaccaggttcagtgcagtggtcctggggacagacttcattctcaacatccgcagccctaagcgcctgaaacgtattttgacagtttttattactgtacaangcgtaagctaagcgacggcctccgggcgtacgttccggaccgaaacggggcccaaaggggtcggaaacgtaccaaaggccggtaaacgtgtcgggactacggaccaaccgtatcgtcgttccttacgaccttcctttccccgacctacg

SEQ ID NO: 441615 - DNA, 660 bp, Homo sapiens
  misc_feature: GZ8MTXP02J4A3U.11.57.F02.1.454.CMB.2.raw
  modified_base (205)..(205): a, c, t, g, unknown or other
  modified_base (255)..(255): a, c, t, g, unknown or other
  modified_base (267)..(267): a, c, t, g, unknown or other
  modified_base (276)..(276): a, c, t, g, unknown or other
  modified_base (390)..(390): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtagggaaacngtcacctctcctgcaggccagtacaaatataacaactactagctgtacanagaactgcagcnccagctctnatctatgatgactagtttaggacggccacgtcgactacctccccgaccgtaggttcaggtggcgtacggtgggtaccgtcggggaacctagtaccttactacttccaccacccncgtcccgacacgtacctagacgtccctaagtaaacgttagtttttcggaactttaaggttttaccttacgtacgttaaccgaaacgagggtccgtaacgccgtaacggccgaccgggtccccgtaccgggtaccgggtaccggttaccggaacccggtaaaacggggaacccgtaaagggggtaccgttaaagaccggaaacgtaccgaacgttggacggactacgacaactcgttcgtcgttactcaccgtttcccaccgaccttatcg

SEQ ID NO: 441616 - DNA, 522 bp, Homo sapiens
  misc_feature: GZ8MTXP02GAXC1.11.57.F02.1.454.CMB.2.raw
  modified_base (281)..(281): a, c, t, g, unknown or other
  modified_base (365)..(365): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccgaggccgggggggtccctgagactctcctgtctagtctctggattcgccttnagtgactatgccatgaagtggtccgccaggctccgaggtaagggctggatggtatttcatacattagctagtagtggtgcgacntatactacgcagactctgtagaagggccgattcatcatctcagacgacatgacaacactcactagtatctagaatacaacagcctagagacgtacgaggacgacggctagtattattattgtgacgtacgaccgtacccccgtacggtacgtaccgg

SEQ ID NO: 441617 - DNA, 579 bp, Homo sapiens
  misc_feature: GZ8MTXP02H6HF4.11.57.F02.1.454.CMB.2.raw
  modified_base (293)..(293): a, c, t, g, unknown or other
  modified_base (375)..(375): a, c, t, g, unknown or other
  modified_base (395)..(395): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttaccaacagaaacctggccaggcctcccagctccncatcatgatgctatttaggagggccactggcactccccaccaggttcaggtggcaggtgggtctgggacagacttcattccncaccatccgcacgcctaganccctagaagtattttgattaagttattacttgtacctaagagtcgtagacgagcgacgggtcctccggaccggtacgttccggaccgaaagggacccgaagggtacggaagacgaaacggacgaacgtggtacgaccgtgaccaccagttccgtgtcttacacttcccgttcccgccttatccg

SEQ ID NO: 441618 - DNA, 527 bp, Homo sapiens
  misc_feature: GZ8MTXP02JDWKS.11.57.F02.1.454.CMB.2.raw
  modified_base (370)..(370): a, c, t, g, unknown or other
  modified_base (390)..(390): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttcagtggcaggtgggtctggggacagacttcattcncaccatccgcagcctagacncctgaagtattttgactagtttattactgttacaacagcgtagcagcacggcctccggcgacgttcggccaagggaccgaaggtggaagtcgaagcgaactggtcgctgcacatctgtctcactccttccgcactcg

SEQ ID NO: 441619 - DNA, 593 bp, Homo sapiens
  misc_feature: GZ8MTXP02IHB3O.11.57.F02.1.454.CMB.2.raw
  modified_base (290)..(290): a, c, t, g, unknown or other
  modified_base (365)..(365): a, c, t, g, unknown or other
  modified_base (376)..(376): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaaactacttagcctggttccaacagaaacctggccaggctccaggctccncatctatgatgcatttaggagggccactggcatcccaccaggttcagtgcagtggtctgggacagacttcattcncaccatcccgnacgtcctagcgacctagaaagtattttgactagtttaatttacttagttactaaacaacgtacgtacgacgacgacgacggtccgtccgggacggtacggttacggtaccggaaacgggaacggaaacggtaaggtaagtacgaaacgaacgaacgtaggtacggtacgtacgacgactaactactcgtcttactactccttacccgtacctactcg

SEQ ID NO: 441620 - DNA, 562 bp, Homo sapiens
  misc_feature: GZ8MTXP02G3TBF.11.57.F02.1.454.CMB.2.raw
  modified_base (262)..(262): a, c, t, g, unknown or other
  modified_base (369)..(369): a, c, t, g, unknown or other
  modified_base (374)..(374): a, c, t, g, unknown or other
  modified_base (389)..(389): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaacctggcaggctcccaggctctcatctatgatgctatttaggagggtccactggcatccccaccagggttcaggtggcaggtggtctgggacagacttcattcncaccntccgcagcctagacncctagaacgtattttgacttagtttaattacgtcgttacaaacgagacgtagacagcaggccctcgggcgtacgtcggaccgaaggggaccgaagggtaggaagtacgaaaggcgaaacgtggtacgggctcggcacctattctgtaccttcacttccttacccgccattccg

SEQ ID NO: 441621 - DNA, 584 bp, Homo sapiens
  misc_feature: GZ8MTXP02JMVCL.11.57.F02.1.454.CMB.2.raw
  modified_base (368)..(368): a, c, t, g, unknown or other
  modified_base (374)..(374): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggcaggctcccagctcctcatctatgatgcatttaggagggccatggcatccccaccaggttcagtggacagtgggtctggggacagactttcattccncaccanccgacacgcctacgacgacgtacgtaagtatttagtactagtttattactacgtactaacgtacgtacgtagacgagacgacggaccgtccggaccggtaccggtaccggaccgaacgggaacggaacggtaggagtacgaacgacgaacgtagtcggtcgtacgacgaccactcttcgtcttactacttaccgttcccgtacctactcg

SEQ ID NO: 441622 - DNA, 537 bp, Homo sapiens
  misc_feature: GZ8MTXP02JHMVE.11.57.F02.1.454.CMB.2.raw
  modified_base (204)..(204): a, c, t, g, unknown or other
  modified_base (365)..(365): a, c, t, g, unknown or other
  modified_base (367)..(367): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccactggcatcccaccaggttcagtgcagtggtctgggacagacttcattcncnccatccgcacgcctagagcctagaagtatttgctagtttattactgtacaacagcgtagcagcacggcctcggcgacgtcggaccgaacgggaccgaaggtggaacgtacgaagacgaacgtgtcggctcgcaccgatctcgtcttcacttccttacccgcctacgttcg

SEQ ID NO: 441623 - DNA, 749 bp, Homo sapiens
  misc_feature: GZ8MTXP02GJN6M.11.57.F02.1.454.CMB.2.raw
  modified_base (205)..(205): a, c, t, g, unknown or other
  modified_base (266)..(266): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtcaaaatattaaacaactacttagcctggttaccaanagaaacctggccaggctccgagctcctcatctatgatgctagtttaggagggccacgtggccactcccccaacccgtagggtttccaaggttcggcgtaggttcggggtctacggggacagtacttacattcctcgaccactcccgacgacgtcccttaggacgtccctagtaaacgtttagtttttcggacttaaggtttttaattacgttacggttacctaaacgtaggtaccgttaagacgtaacgacgtaacccgggtcccgtacccggggaccggttaaccggggttacccgggaaacccgggtaaacggggaacccggtaaaacggggttagggaaacgggttaacgaaaacgggtaacggtaaaaccggttgggttacggggccgttacggaccctaaacccgtaacgtttcgttaaccggtttcctttaaccggtacctttcccgtttacccccggtactttaacgtttacccgg

SEQ ID NO: 441624 - DNA, 562 bp, Homo sapiens
  misc_feature: GZ8MTXP02FJPP9.11.57.F02.1.454.CMB.2.raw
  modified_base (306)..(306): a, c, t, g, unknown or other
  modified_base (458)..(458): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccaggccggggggtccctgagactctcctgtctagtctctggattcgccttcagtgactatgccatgaagtgggtccnccaggctccgaggtaaggggctgggaatggatttcatacattacgcagtagtggtgccgactatactaactacgcagactctggtagaagggccctattcatcatcctcagagacatgacaaacactcactgtatctaggaaactcaaacgngaccgtagaaagacggttacggaaacggaccgaaacggcttagtaaattacgtttaagtggtacgacggtacggacccgtacccccgtacgggtcgaacccggg

SEQ ID NO: 441625 - DNA, 527 bp, Homo sapiens
  misc_feature: GZ8MTXP02HH4XO.11.57.F02.1.454.CMB.2.raw
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatataacaactacttagcctggttccaacagaaacctggccaggctcccaggctcctcatctatgatgcagtttaggagggccactggcagtccccaccaggttcagtggcaggtggtctggggacagacttcattctcnccatccgcagcctagacgcctagaagtattttgctagtttattactgtacaacagcgtagcagcaggcctcggcgacgttcggccgaacgggaccgaaggtaggaagtcaagcgaacgtgtcggctgcaccatctgtctcactctccgctactcg

SEQ ID NO: 441626 - DNA, 629 bp, Homo sapiens
  misc_feature: GZ8MTXP02HBP37.11.57.F02.1.454.CMB.2.raw
  modified_base (203)..(203): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaatataacaactacttagcctggtccaacagaaacctgccaggctcccaggctcctcatctatgatgctagtttaggagggccactggcactccccacctaggttcagtggcaggtgggtctcggggacagacttcattctcaccatccgcacgtcctaagacgccctagtaaagtacttttgacgttaagttttacttacttacgttacaaacgtagtaccgtaagcgaaggtccaacgggtcccgtccgggtaccggtaaccggttccggggaccgtaaacgggggaaaccgaacggggtaggaaacgtacgaaaggacgtaaaccgtggtacggcgtacggaccaaccacgttactcgttccgttcgtacttcccgtttccccgacctacgtttccg

SEQ ID NO: 441627 - DNA, 586 bp, Homo sapiens
  misc_feature: GZ8MTXP02JKPEF.11.57.F02.1.454.CMB.2.raw
  modified_base (358)..(358): a, c, t, g, unknown or other
  modified_base (371)..(371): a, c, t, g, unknown or other
  modified_base (391)..(391): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttaccaacagaaacctggacccaggctcccaggctctcatctatgatgctagtttaggacggccagtggcactcccaccagttcagtgcagtggtctggacngacttcattcacncactccgacacgcctagacncctagaagttatttagactagttttaacttacttgtaacaaacgagacgtagcgagcacgggccgtccgggcgtaccggttacggaccgaaacgggaaccgtaaagggacggtaagtacgaaagacggtaacgtggtcggactcgaccgaccgattacgtcgttcttactacttccgttaccccgactacttccg

SEQ ID NO: 441628 - DNA, 628 bp, Homo sapiens
  misc_feature: GZ8MTXP02G1LXC.11.57.F02.1.454.CMB.2.raw
  modified_base (235)..(235): a, c, t, g, unknown or other
  modified_base (262)..(262): a, c, t, g, unknown or other
  modified_base (288)..(288): a, c, t, g, unknown or other
  modified_base (378)..(378): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatnttaacaactacttagcctggttccaanagaacctggcaggctcccaggctccncatctatgatgctagtttaggagggccacgtggcaactccccacccgaggtttcaggtcggcagtgggtctggggacagtacttcattcncaccatccgcacgcctagacgccctagaagtatttgactagtttattactagtcaacgagacgtagcagcacggccgtcggcggtacggttccggaccgaaacggggaacccgtaaggggtacggtaaacgtacgaaacggtaccgaaacgttcggttacggaccgttacgacccgtaacccgtacttacccgttcggttacccgttaccgtaactttacccgtttccccggacccttactttaacccgg

SEQ ID NO: 441629 - DNA, 511 bp, Homo sapiens
  misc_feature: GZ8MTXP02IMW45.11.57.F02.1.454.CMB.2.raw
  modified_base (362)..(362): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttcagtgactatgccatgaagtggtccgccaggctccaggtaaggggctgggaatggatttcatacattagcagtagtggtgcgacntatactacgcagactctgtagaggccgattcatcatctaccagagacaatggacaacaactcactgtatctagaaactcaaacagcctagagagtcgaggacacggctgtatattattgtgcgacgacgcccccgtaggtacgtaccgg

SEQ ID NO: 441630 - DNA, 611 bp, Homo sapiens
  misc_feature: GZ8MTXP02ICXN9.11.57.F02.1.454.CMB.2.raw
  modified_base (358)..(358): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggttttccttgttgctattttagaaggtgtccagtgcgaggtgcaagtggtgcagtcgtgggggagcttagtccgaggccggggggtccctgagactctcctgtctagtctctggattcgccttcagtgactatgccatgaagtcggtccgcaggctccgaggtaaggggctgggaatggatttcgatacattacgctagtagnggtgcgacctatatacctacgacagtactctgtagaagggccagttcatcatctccagacgacagtagacaaacaactacactagtactcgtaaggtaaataccaaacgtagacccgtagaacggtacggtaccggaaagggaccgtaacccggtacgttacggttaactttaacgtttaaagttgggttacggaccggtaacgggacccggtaccccccccggttaaggggtttaccggtaaacccccgggg

SEQ ID NO: 441631 - DNA, 556 bp, Homo sapiens
  misc_feature: GZ8MTXP02H52PI.11.57.F02.1.454.CMB.2.raw
  modified_base (204)..(204): a, c, t, g, unknown or other
  modified_base (258)..(258): a, c, t, g, unknown or other
  modified_base (362)..(362): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactactagcctgtcaanagaactggcagctccagctctcatctatgatgcagtttaggagggccatggcactccccaccaggttcagtggcaggtgggtctggggacagtcttcattctcnccatccgcagccctagacgtcctagaagtattttgactaaggtttatttactgtacaaacgagtcgtagcagcgacggccgtaccggcgacgttcgaccgaagggaccagggtagaagtcgaaacgcgaaactggtcggactcggacaccgtattccgttgttccttacgacttcccgtccccgcttaacgtcg

SEQ ID NO: 441632 - DNA, 541 bp, Homo sapiens
  misc_feature: GZ8MTXP02I79UO.11.57.F02.1.454.CMB.2.raw
  modified_base (310)..(310): a, c, t, g, unknown or other
  modified_base (353)..(353): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggcttttgttggagaccttgcacttgtactccttgccattcagccagtcctggtgcaggacggtgaggacgctgaccacacggtacgtgctgttgtactgctcctcccgcggtctttgtcttggcattatgcacctccacgccgtccacgtaccagttgaacttgacctcagggtctcgnggctcacgtccaccaccacgcatgtcgacctcgacggggtccnccaggcctcccgagggtagggctggatggatttcatacattagcagtagtggtgcgacatatactacgacagactctgtacccccgaggaccgattcatacactctaccagagacaatagacaacaactacactagtatacgtagaaactacaacacgactaagagacgtacgaggacgacggactag

SEQ ID NO: 441633 - DNA, 555 bp, Homo sapiens
  misc_feature: GZ8MTXP02HXT5B.11.57.F02.1.454.CMB.2.raw
  modified_base (374)..(374): a, c, t, g, unknown or other
  modified_base (394)..(394): a, c, t, g, unknown or other
  modified_base (404)..(404): a, c, t, g, unknown or other
  modified_base (428)..(428): a, c, t, g, unknown or other
  modified_base (516)..(516): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcactccccacctaggttcagtggcagtgggtctggggacagacttcatttctcncctatccgcacgcctagacncctgaaagtntttgctagtttattactgtcaacngactagcagcaggcctccggcgacgttcggaccaaggggaccaagggtcggaagtcgaaggacgaacgtggtcggactcgccaaccgngttcgtcgttctttacacttcccgtttcccgctaactcg

SEQ ID NO: 441634 - DNA, 564 bp, Homo sapiens
  misc_feature: GZ8MTXP02HB9DY.11.57.F02.1.454.CMB.2.raw
  modified_base (278)..(278): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctgtcaacagaacctgcagctccagcnctcatctatgatgcagtttaggagggccacgtggcactccccaacctaggttcaggtggctaggtgggtctcggggacagtacttcattcctcaccatccgcagcctagacgtcctagaattatttgcttaagtttattacgtagtacaaacgtagacgtagcagcgacggccgtccgggcgtacgttccggacgaacgggaccgaaggtaggaaagtcgaaacggcgaaacgtgtacggctcggacaccgtatcgtaagtcttcacttccgtccacctacgttcg

SEQ ID NO: 441635 - DNA, 549 bp, Homo sapiens
  misc_feature: GZ8MTXP02FZP2Q.11.57.F02.1.454.CMB.2.raw
  modified_base (204)..(204): a, c, t, g, unknown or other
  modified_base (262)..(262): a, c, t, g, unknown or other
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctccaggctctcatctatgatgcatttaggaggccactggcatcccaccaggttcagtgcagtggtctgggacagacttcattctcaccatccgnacgcctagacgcctagaagtatttgactagtttattactgtacaacagacgtagcagcaggcctccggacgtacgttccggaccgaagggaccgaaaggtaggaagtacgaaagacgaaacgtggtacggactacggccacgatcgtgttcttacactcctttcccgcctacttccg

SEQ ID NO: 441636 - DNA, 697 bp, Homo sapiens
  misc_feature: GZ8MTXP02IIOL3.11.57.F02.1.454.CMB.2.raw
  modified_base (280)..(280): a, c, t, g, unknown or other
  modified_base (362)..(362): a, c, t, g, unknown or other
  modified_base (364)..(364): a, c, t, g, unknown or other
  modified_base (372)..(372): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaatataacaactactagcctggtcaacagaactgcaggctccagctccncatctatgatgctatttaggagggccacgtggcactccccacctaggttcagtggcaggtggtctgggacagacttcattcncnccatccgnacgcctagacgtcctagtaagtagttttcgacgttagttttaactttacgttaggttaacctaaacgtacggtaccgttaacggcgtaaacggtccgtaaccgggtccccgttacccgggccgggtaacccgggtttccgggaacccggtaaacgggggaacccgtaaacgggggtacgggtaaacgtaaccggaaaacggtaccggtaaaacggttcgggtacggtaccgttaccggacccgtaacccgttaacgttccgttaacggtttacccgtttacctaccgtttaccccgtttacccccggaccttaacgtttacccgg

SEQ ID NO: 441637 - DNA, 547 bp, Homo sapiens
  misc_feature: GZ8MTXP02GAXQL.11.57.F02.1.454.CMB.2.raw
  modified_base (518)..(518): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccaccaggttcagtgcagtgggtctgggacagacttcattctcaccatcccgcagcctagacgcctagaagtattttgctagtttattactgtacaacagacgtagcagcgacggcccgtccggcgtacgttccggaccgaaaggggaccgaaagggtggaaagtcaaggacgaactggacggctggcaccgntactgtcttcacttccgtcccgctctacg

SEQ ID NO: 441638 - DNA, 671 bp, Homo sapiens
  misc_feature: GZ8MTXP02F260A.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtcaaaatattaacaactacttagcctggttccaacagaaacctggccaggctcccgggctcctcatctatgatgctatttaggaggccatggcactcccaccaggttcagtggcaggtcggtcgtgggacctaggtacttcatttcctaccaacctcgtcccgctacggtaccctaaggacgtccgtaggtaaagttgttttaggactttaagtttattacgtagtaccaaatacggtcgtaagctaggaccacgggtcccgtaccgggaccgtacgggttaccggaacccggaaaggggacccgaaagggttacgggaaagtaccgaaagggtaccgaaaacgttcggggaccggacgttcggacctaacccgtacttccgttacggttccgtttaaccgaactttacccccggtccccgtacctacggttacctttaacgggg

SEQ ID NO: 441639 - DNA, 525 bp, Homo sapiens
  misc_feature: GZ8MTXP02GLIUO.11.57.F02.1.454.CMB.2.raw
  modified_base (350)..(350): a, c, t, g, unknown or other
  modified_base (457)..(457): a, c, t, g, unknown or other
  modified_base (495)..(495): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgccacctccacgccgtccacgtaccagttgaacttgacctcagggtcttcgtggctcacgtccaccaccacgcatgtgacctcaggggtccnccaggctccccgagggtaagggctggaatggatttcatacattagcagtagtggtgcgaccatatactacgcagactctgtagaaggccgattcatcatctccaganacaatggacaacaactcactgatctagaaactcaaacngactaagagacgtacgagacgacggactag

SEQ ID NO: 441640 - DNA, 586 bp, Homo sapiens
  misc_feature: GZ8MTXP02HCVOE.11.57.F02.1.454.CMB.2.raw
  modified_base (262)..(262): a, c, t, g, unknown or other
  modified_base (378)..(378): a, c, t, g, unknown or other
  modified_base (389)..(389): a, c, t, g, unknown or other
  modified_base (435)..(435): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcagtttaggagggccacgtggcactccccaccaggttcaggtggcaggtgggtctcggggacagtacttcatttccncaccatcccgnacgtcctagacgcctagaagtatttgactagtttatactgtacaanagcgtagcagcgacggccgtcggcgtacgttcggacgaagggaccgaagggtacggaagtacgaaacggtacgaaacgttggtacggccgtacgaccaccgtacttccgtcgttccttacgtacttcccgtttaccccgacctaactttcg

SEQ ID NO: 441641 - DNA, 515 bp, Homo sapiens
  misc_feature: GZ8MTXP02GYEZU.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccaggccggggggtcctgagactctcctgtctagtctctggattcgccttcagtgactatgccatgaagtggtccgccaggctccgagggtaaggggctagggaatggatttcatacattagcagtagtggtgcgacatatactacgcagactctgtagaggccgtattcatcatcctcagagacaatggacaaacactcactgtatcgtaagaactacaaacacgactagagacgacgagacaggctgtatattatgtgacgacgacgaccccgtacggcgtaccgg

SEQ ID NO: 441642 - DNA, 602 bp, Homo sapiens
  misc_feature: GZ8MTXP02HNNBP.11.57.F02.1.454.CMB.2.raw
  modified_base (291)..(291): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaacaactacttagcctggttccaacagaaacctggccaggctccaggctcctnatctatgatgctatttaggagggccacgtggcactccccaacccgagggttccaggtggcgaggtggggtctggggaccaggtactttcatttcctacaccctatcccgacacgcctagacgccctagaacgtattttgacttagttttattacgttgtacaaacgagacgtagacagcgacggcccgtcggacgtacgttccgaccgaacgggaccgaagggtaggaacgtacgaacggtacgtaaacgtggtacgggctcggaccacctagtcgtcgtccttactaccttcccttcccgacctacttcg

SEQ ID NO: 441643 - DNA, 534 bp, Homo sapiens
  misc_feature: GZ8MTXP02H1J44.11.57.F02.1.454.CMB.2.raw
  modified_base (277)..(277): a, c, t, g, unknown or other
  modified_base (375)..(375): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacagtcaccctctcctgcagggccagtacaaaatataacaactactagcctgtcaacagaactgcagctccagctcncatcatgatgctagtttaggagggccagtggcatcccaccaggttcagtgcaggtggtctgggacagacttcattctacaccatccgcagcctaagcncctagaaagtatttgactaagttattactgtacaactagcgtagcagcacggcctacggcggacgttcggaccgaagggaccgaagggtacgaagtacgaaagtcgaaaacgttggacgcgtcgacactagtctgtcttacactccttcccgctactcg

SEQ ID NO: 441644 - DNA, 532 bp, Homo sapiens
  misc_feature: GZ8MTXP02H53ZI.11.57.F02.1.454.CMB.2.raw
  modified_base (361)..(361): a, c, t, g, unknown or other
  modified_base (367)..(367): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccgaggccggggggtccctggagactctcctgtctagtctctggattcgccttcagtgactatgccatgaaggtggtccgccaggctccgaggtaaggggctaggatggatttcgatacattagcagtagtggtncgaccntatactacgcagactctgtagagggccgtatcatcatctccagagacatgacaaacaactcactgtatcgtaggaaatcaaactacgctagaacgtacgacggaggacgacggtactagtattagttagtgtaggacgtacgacgtcccccgtagggcgtaccgg

SEQ ID NO: 441645 - DNA, 638 bp, Homo sapiens
  misc_feature: GZ8MTXP02J34IF.11.57.F02.1.454.CMB.2.raw
  modified_base (257)..(257): a, c, t, g, unknown or other
  modified_base (272)..(272): a, c, t, g, unknown or other
  modified_base (277)..(277): a, c, t, g, unknown or other
  modified_base (379)..(379): a, c, t, g, unknown or other
  modified_base (413)..(413): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaatataacaactactagcctgtcaanagaactgcagctccngctcnatctatgatgctagtttaggacgggcctacgtggccacctccccgacccgaggttcaggtggcgtaggtgggtctgggacagtacttacacttcctacaccnctcccgcacgtcctagactccgtagtaaacgttnttttcgacttaagttttattacgtgtaaccaacgtacggtcgtacgccaggccgtacgggcccgttcccggggaccggttaacccggttaccggaacccggtaaacggggaacccgtaaggggttacgtaacgtaccgaaaggtccgtaaacggtggtacggtcctacgcctaacctcttccgtcgttaccttcctaccttccccgtaccccgtctaacgttccg

SEQ ID NO: 441646 - DNA, 517 bp, Homo sapiens
  misc_feature: GZ8MTXP02FGCGG.11.57.F02.1.454.CMB.2.raw
  modified_base (376)..(376): a, c, t, g, unknown or other
  modified_base (412)..(412): a, c, t, g, unknown or other
  modified_base (419)..(419): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccacccaggtcagtggcagtgggtctgggacagacttcattctcacccatccgnagcctagacgcctgaagattttgctagtttattacngtcaacngcgtagcagcaggcctcggcgacgttcggcaagggaccaaggtggaagtcaagcgaaactgtagctgcaccatctgtcttcactccttcccgcactcg

SEQ ID NO: 441647 - DNA, 538 bp, Homo sapiens
  misc_feature: GZ8MTXP02GIZJO.11.57.F02.1.454.CMB.2.raw
  modified_base (262)..(262): a, c, t, g, unknown or other
  modified_base (366)..(366): a, c, t, g, unknown or other
  modified_base (385)..(385): a, c, t, g, unknown or other
  modified_base (507)..(507): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcatttaggagggccatggcatccaccaggttcagtggcagtggtctgggacagacttcattctcnccatcccgctagccctagngcctgaagtattttgctagttattactgtcaacagcgtagcagcacggccgtccggcgacgttcggaccaagggaccgaaggtggaagtcgaaacgcgaacgtgtacggctcggaccaacgntacgtgtcttcactccttcccgacctactcg

SEQ ID NO: 441648 - DNA, 608 bp, Homo sapiens
  misc_feature: GZ8MTXP02GHMTA.11.57.F02.1.454.CMB.2.raw
  modified_base (204)..(204): a, c, t, g, unknown or other
  modified_base (381)..(381): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaaacaactacttagcctggttaccaacagaaacctggccaggctcccaggctcctcatctatgatgactagtttaggagggccacgtggccactccccacccaggttccaggtggcaggtggtctgggacagtacttcattccncaccgatcccgcacgccctagacgtcctagaagtattttgactagtttattactgtacaactagacgtagcagcgaacggtccctaccgggcgaccggttaccggaccgaaacggggaaccgaagggtaggaaacggtacgaacggaccgtaaacgtgtcggaccgtacgccgtaaaccgcttacgtcgttacttcgtacttccccttacccgaccctagtttaccg

SEQ ID NO: 441649 - DNA, 588 bp, Homo sapiens
  misc_feature: GZ8MTXP02H24VZ.11.57.F02.1.454.CMB.2.raw
  modified_base (292)..(292): a, c, t, g, unknown or other
  modified_base (371)..(371): a, c, t, g, unknown or other
  modified_base (376)..(376): a, c, t, g, unknown or other
  modified_base (378)..(378): a, c, t, g, unknown or other
  modified_base (395)..(395): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaaacaactattagcctggttccaaacagaaacctggccaggcctccaggcctcncatctatgatgctaagtttagggagggtccagtggcactccccaccaggttcagtggcaggtggtctgggacagacttnattcncncatccgacagcctagancctagaacgtattttgctaagtttacttactagtacaacacggtcgtagcagcacgggccctcgggaccgtacgttacggaccgaaacggggaccaaaggggtacgaacggtacgaaaaggtcgaaacgttggacggttcacggaccacctatccgtgttctacgtactcccgtttccccgctaacgtttccg

SEQ ID NO: 441650 - DNA, 627 bp, Homo sapiens
  misc_feature: GZ8MTXP02GLFHV.11.57.F02.1.454.CMB.2.raw
  modified_base (205)..(205): a, c, t, g, unknown or other
  modified_base (479)..(479): a, c, t, g, unknown or other
tcagcgagagataccacgaccggtgctcgatttagctcgatatagttgggtttgggggaggaactgctcagttaggatccagagggaaccatggaagccccagctcagcttctcttcctcctgctacactggctcccagataccaccggagaaattgtgttgacacagtctccggccaccctgtctgcgtctccgtggggaaacngtccaccctctcctgcagggccagtacaaaatattaaacaactacttagcctggttaccaacagaacctggccaggctcccaggctcctcatctatgatgctaagtttaggggacgggcccaagtggaccaactcccccgaaccccgtaggtttccaggtcggccgtaggttcggggtcccgtaggggacaggtacctttcaactttcctccaccactcccgacacgcctagacgtcctagaaagtatttgacttaagtttattactgtacaanagtcgtagcaagctaggccctcgggacgtaccggttcggaccgaacgggaaccaagggtagaaacgtacgaaacggacgaaacgtggtacggactacgacctaacccgtattccgtcgttaccttcaacgtttcccttcccgactacg

SEQ ID NO: 441651 - DNA, 579 bp, Homo sapiens
  misc_feature: GZ8MTXP02JGBA3.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaaacaactacttagcctggttaccaacagaaacctggccaggctcccaggctcctcatctatgatgctagtttaggagggccacgtggcactccccacccgaggttccagtggcagtgggtctggggacagacttcattctcaccatccgcacgcctagacgcctagagtattttgcttagtttattactgtacaactagagtagacgagcgacggccgtacggccggtaccggttccggaccgaaacgggaccgaacgggtaggaagtacgaagacgaaacgtggtacgtcgtcggacacctactcgtcgtccttactactcccttacccgcctacttccg

SEQ ID NO: 441652 - DNA, 558 bp, Homo sapiens
  misc_feature: GZ8MTXP02HC409.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgcatttaggagggccacgtggcactcccacccaggttcagtcggcaggtgggtctggggacagtacttcattcctcaccatccgcacgcctagacgcctagagtatttgctagtttattactgtacaacgagcgtagacagcacggcctccgggcgtacggttccggaccgaagggtaccgaaggtcggaagtacgaacgcgtaacgtggtcgcgtcgaccgactagtctaagtcttcactccttacccgctactcg

SEQ ID NO: 441653 - DNA, 600 bp, Homo sapiens
  misc_feature: GZ8MTXP02F2ZO8.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccaggctcctcatctatgatgctagtttaggacgggccacgtcggaccactccccacccgtaggttccaggtcggcgtaggtgggtcgtggggacagtacttcgattcctcacctagtcccgcacgccctaaggacgtcctagaattatttcgacttagtttacttactgtacaacgtagacgtagacagcgacggtcctccggacgtacgtccggaccgaagggaccgaagggtaggaacgtacgaagtaccgaacgtggcggcgtacgacctaccgtatcgtcgttcttactacgttcccttacccggactacgttacg

SEQ ID NO: 441654 - DNA, 546 bp, Homo sapiens
  misc_feature: GZ8MTXP02JR0QL.11.57.F02.1.454.CMB.2.raw
  modified_base (372)..(372): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttaggtccgaggccgggggggtccctggagactctcctgtctagtctctggattcgccttcagtgactatgccatgaagtggtccgccaggctccgaggtaaggggctagggaatggatttcgatacattagcagtagtggtgcgaccntatactacgcagactctgtagaggccgtattcatcatcctaccaagacgacaagtggaccaaacaactacactgtactacgtagaatacaacagaccgtagaagacgtacggaggacgacggctagtattattagttgtcgacggtacgaccgacccccgtaggtacgtaccgg

SEQ ID NO: 441655 - DNA, 584 bp, Homo sapiens
  misc_feature: GZ8MTXP02J3OBT.11.57.F02.1.454.CMB.2.raw
  modified_base (373)..(373): a, c, t, g, unknown or other
  modified_base (381)..(381): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgagtgcaagtggtgcagtcgtgggggagtcttagtccgaggcccggggggtcctgagactctcctgtctagtctctggattcgccttcagtgactatgccatggaagtcgggtccgccgaggcctaccgaggggtaaggggctaggaatggtatttcaatacattacgcaggtagtggtnccgtaacntactactacgcagacttcgtgtagaaacgggcctattcatcactctaccgagaacgacaagtcgacaaccactcacgtagtactacgtacggtaaactaccaacgtacgaccgtaggaacgtacggtacggacggaccgacggtacttagtacttagttaagttgtacgacgacggtaccgcccccgttaaggtcgacccggg

SEQ ID NO: 441656 - DNA, 577 bp, Homo sapiens
  misc_feature: GZ8MTXP02HADMS.11.57.F02.1.454.CMB.2.raw
  modified_base (238)..(238): a, c, t, g, unknown or other
  modified_base (257)..(257): a, c, t, g, unknown or other
  modified_base (309)..(309): a, c, t, g, unknown or other
  modified_base (323)..(323): a, c, t, g, unknown or other
  modified_base (328)..(328): a, c, t, g, unknown or other
  modified_base (349)..(349): a, c, t, g, unknown or other
tcagcgagagataccacgaccggtgctcgatttagctcgatatagttgggtttggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctccgnggtctttgcttggctattntgccacctccacgccgtccacgtaccagttgaacttgacctcgaggtctcgngctcacgtccaccncacgnatcgcgacctgacggggtccnccgaggcctacccgaggggtaggctaggaatggatttcgatacattagctagtacgtggtcgacgaacctatactacgtacgactacgctacgtgtacggaacgggcctaattccatcaacttcctaccaagacgaacaagtcggaacaaactactcaactagtactacgtaaggaaactcgaaacgacgaccgtaagaacggtagacggaagaccaggtactttaag

SEQ ID NO: 441657 - DNA, 665 bp, Homo sapiens
  misc_feature: GZ8MTXP02FRA20.11.57.F02.1.454.CMB.2.raw
  modified_base (202)..(202): a, c, t, g, unknown or other
  modified_base (302)..(302): a, c, t, g, unknown or other
  modified_base (628)..(628): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctccagataccacggagaattgtgttgacacagtctccggccaccctgtctgcgtctccgtaggggaaacngtccaccctctcctgcagggccagtacaaaatattaacaacttacttagcctaggttaccaacagaaacctggccaggcctccaggcctcctcactctangatgactagtttaggacgggccacgtcggacctactaccccgaccgtagggttccagggttcggacgtaggtcggggtcgtacggggaacctacgtacctttactactttccctaccacccgactcccggactacgtccctaaggacgtaccgttagtaagttacttttacgacgtttaatttacttactgttaacaacgagtacgtagactacgcgaccgggtcccgtaccgggacggtacccggtaccggaccggaaacggggaccgtaaggggtacgaaacggtacgaacggtacgtaagtcggtacggctacgacctaccgngttacctgttctactacgtcccttccgacttactacg

SEQ ID NO: 441658 - DNA, 587 bp, Homo sapiens
  misc_feature: GZ8MTXP02JB5SU.11.57.F02.1.454.CMB.2.raw
  modified_base (356)..(356): a, c, t, g, unknown or other
  modified_base (372)..(372): a, c, t, g, unknown or other
  modified_base (439)..(439): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccaggctctcatctatgatgcatttaggacggggccacgtggcactccccaccctaggttcagtggcaggtgggtcngggacagcttcattcncaccatccgcacgcctagacgtcctagaacgttattttcgacttagtttaacttactgtacaaacgngacgttagcacgcgacgggccctccgggcgtaaccgttcggaaccgaacggggaccgaagggtaggaagtcgaaacggacggaactgggttcggctcgacaccctagtccgtaagtcccttacacgtttccgtccccgactaactccg

SEQ ID NO: 441659 - DNA, 555 bp, Homo sapiens
  misc_feature: GZ8MTXP02I5P9O.11.57.F02.1.454.CMB.2.raw
  modified_base (262)..(262): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctccagctcctcatctatgatgcatttaggagggccatggcatccccaccaggttcagtggctagtgggtctggggacagtacttcatttcctcaccatcccggcacgccctagacgtccctagaagtattttgctagtttattactgtacaacagcgtagcagcaggtcccgtccggcgtaccgttcggaccgaaacggggacccgaaagggtggaaagtacgaaggacgaactggtcggctgccaccgatctgtcttcactccttcccgcacttcg

SEQ ID NO: 441660 - DNA, 746 bp, Homo sapiens
  misc_feature: GZ8MTXP02HDJRR.11.57.F02.1.454.CMB.2.raw
  modified_base (205)..(205): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtccacctctcctgcagggccagtacaaaatattaacaactacttagcctggttaccaacagaaacctggccaggctccaggctcctcatctatgatgactagtttaggacggggtcctacgtggccactccccgaaccccgtagggtttccaggttcgggctaggtcggggtctacggggacaggtaccttcgtaactttccacctacccgtacgttccccggacaacggtccccttaaggaacgtccccgttagtaaacgttagtttttacgaccgtttaagttttaacgtttaacgttacggttaccaaaccgtaggtacgttaggacctaacggtccgaaccgggtcccgttacccgggggacggttaacccgggtttacccgggaacccggtaaaacgggggaaccccgtaaagggggttacgggaaacggtacgaaaacgggtacggtaaaaccggtgggttacgggacgttcggaccgaacctacgttaccgtgttccttaccgtacttcccgttacccgtccgtactttccgg

SEQ ID NO: 441661 - DNA, 543 bp, Homo sapiens
  misc_feature: GZ8MTXP02HOIHV.11.57.F02.1.454.CMB.2.raw
  modified_base (300)..(300): a, c, t, g, unknown or other
  modified_base (311)..(311): a, c, t, g, unknown or other
  modified_base (355)..(355): a, c, t, g, unknown or other
  modified_base (515)..(515): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggctattatgcacctccacgccgtccacgtaccagttgaacttgaccctnagggtcttcgnggctcacgtccaccaccacgcatgtgaccctcgacggggtcccnccaggcctccccgaggggtaacggggctagggaatggatttcgattacattagctagtagtggtgcgaccatatactacgacagactcgtgtagaagggccgtattcatcatcctaccagagacaatcgacaacactctactgtatctagaaactcaacngctaagagacgtacgagacacggtctag

SEQ ID NO: 441662 - DNA, 631 bp, Homo sapiens
  misc_feature: GZ8MTXP02JGBR0.11.57.F02.1.454.CMB.2.raw
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttccaacagaactgccaggctccagctcnatctatgatgctagtttaggagggccacgtggcactccccacccgaggttcaggtggcgtaggtcgggtctcggggacagtacttacacgttctcaccactcccgactacgtccctaagacgtaccctagtaaacgtaagtttttcgacttaaggttttactttaactcgttaccgaacgtagtacgttaagacgtaacggcgacggtcccgtacccgggtaccggtaccggttaccggggaccgtaaacggggacccgtaagggtacggaacgtacgaacggacgtaacgtcggtacggctacgaccaccgagttctcgtcttacacgtcctacccgctacttcg

SEQ ID NO: 441663 - DNA, 609 bp, Homo sapiens
  misc_feature: GZ8MTXP02ISICS.11.57.F02.1.454.CMB.2.raw
  modified_base (203)..(203): a, c, t, g, unknown or other
  modified_base (260)..(260): a, c, t, g, unknown or other
  modified_base (374)..(374): a, c, t, g, unknown or other
  modified_base (462)..(462): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcaggccagtcaaaatattaacaactacttagcctggttccaanagaaacctggccaggctccaggctcctcatctatgatgctagtttaggagggccacgtggcactccccaccaggttcagtggcaggtgggtctggggacagtacttcattctcnccatccgacagcctaagacgcctagaacgtatttgcttaagtttattaactgtacaactagcgtagcaaggcacggtcctacccgggngtaaccggttcggacccgaaaggggacccgaaaggggtacggaaacgtacgaaaacggacggtaaaacgtggtacggacgtacggaccaaccttagtccgttaacggttccttacgtaccttccgtttacccccgactaactttccg

SEQ ID NO: 441664 - DNA, 549 bp, Homo sapiens
  misc_feature: GZ8MTXP02F02U3.11.57.F02.1.454.CMB.2.raw
  modified_base (365)..(365): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccatggcatcccaccaggttcagtgcagtggtctgggacagacttcattctcnccatccgcagcctagacgcctagaagtattttgactagttttattacgtgttacaactagacgtagactagcacgggcctccggacggtaccgttccggccgaacggggaccgagggtggaagtcgaaggacgaacgtggtcggactcggcaccagtctgtcttcactccttcccgactactcg

SEQ ID NO: 441665 - DNA, 621 bp, Homo sapiens
  misc_feature: GZ8MTXP02FUIYJ.11.57.F02.1.454.CMB.2.raw
  modified_base (393)..(393): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgctagtttaggagggccacgtggccactccccacccgtagggttcaggtggcaggtgggtctggggacagtacttcattctcaccatcccgnacgcctagacgcctagaagtattttgactagttttattactgtacaacgagtcgtagcagcgaggtcccgtccgggacgtacggttccggaccgtaaacggggaccgtaaaggggtacggaaacgtacgaaaaggtacggtaaaacgtgggttacggcgttacgaccgtaacctacgttcgtaacggttcctttactacgtttccctttccccggacctactttccgg

SEQ ID NO: 441666 - DNA, 606 bp, Homo sapiens
  misc_feature: GZ8MTXP02HFVDO.11.57.F02.1.454.CMB.2.raw
  modified_base (271)..(271): a, c, t, g, unknown or other
  modified_base (279)..(279): a, c, t, g, unknown or other
  modified_base (354)..(354): a, c, t, g, unknown or other
  modified_base (359)..(359): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtacaaaatataacaactactagcctgtcaacagaactgcagcnccagctcncatctatgatgctagtttaggaggccatggcactcccacctaggttcaggtgcgaggtggtctgggacagacttnattcncaccactccgcacgacctagacgtcctagaagttacttttgacttaagtttaattacgtacgttacaaacgagtacgtaagcaacggtaccgaacgggtcccgtccgggaccgtaaccgggttccgggaacccgaaacggggaaccgtaaaggggtaggtaaacggtacgaaaacggcggtaaacgtggtacggcgtacgaccacgactcgtcgtcttactacgttccttccccgtacctacgttcg

SEQ ID NO: 441667 - DNA, 715 bp, Homo sapiens
  misc_feature: GZ8MTXP02JV1AW.11.57.F02.1.454.CMB.2.raw
  modified_base (286)..(286): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatataacaactacttagcctggtccaacagaacctggccaggctcccagctcctnatctatgatgctagtttaggacgggtccagtggcactccccaacccgtaggttccaggtcggacaggtcggggtctggggacagtaccttacatttccgtacacccgtatccccggcacgtccctaaggacgtcccgtagtaaacgttatttttcggacttaaaggtttttaacttacgttacggtaactaaaccgtagtaccggttaagacgtacggaccgtaccggggtcccgttacccggggaccgggtaacccggtttcccgggaacccggaaacgggggtaaacccgaaagggggtttacgggaaaacggttaccgaaaacggtaccggtaaaacggttgggtccgggtacgtacgacccgaacccgtatttaccgttggtaccctttacgtaccgttcccgtttcccccggacctactttccg

SEQ ID NO: 441668 - DNA, 658 bp, Homo sapiens
  misc_feature: GZ8MTXP02GSBAP.11.57.F02.1.454.CMB.2.raw
  modified_base (261)..(261): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcacctctcctgcagggccagtcaaaatattaacaactacttagcctggttccaanagaacctggccaggctccaggctcctcatctatgatgctagtttaggagggccacgtggcatccccaccctagggttcaggttcggactaggtcgggtcgcggggacagtacttcgactttcctacaccctacgtcccgacacgtaccctagacgtcccgtagaaagttacttttagacgttaagtttttaacttacgttcggtactaaacgtaggtacgttaacggcaacggacgaccgggtacccgtcccggggtaccggtaccggttaccggggacccgtaaacgggggaacccgtaaaggggtacgggaaacgtacgaaaggtccgaaacgttggtacggtcacgtccaacgtacttcgtgtttcctacgtacttccctaccgtcctacgtcg

SEQ ID NO: 441669 - DNA, 668 bp, Homo sapiens
  misc_feature: GZ8MTXP02GCJZW.11.57.F02.1.454.CMB.2.raw
  modified_base (265)..(265): a, c, t, g, unknown or other
  modified_base (356)..(356): a, c, t, g, unknown or other
  modified_base (375)..(375): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatattaaacaactacttagcctggttaccaanagaaacctgccaggctccaggctcctcatctatgatgctagtttaggacgggccacgtggcactccccaccaggttcagtgcagtgggtcngggacagtacttcattccncaccactccgacacgcccgtagacgtacctagaagttagtttgacttagtttattactgttacaacgtagacgtacgagacgacgacggccgtaccggacggtaaccggttcccgggaacccggaaacgggggaacccggtaaaaggggtcgggtaaaacggtacgaaaacgggtaacgtaaacccggttgggttacggggaccgttacgggacctaacccgtaacggtttccttaacggttaccctttaccggtaaccgtttacccttcccccggtacctaacctttaccgg

SEQ ID NO: 441670 - DNA, 572 bp, Homo sapiens
  misc_feature: GZ8MTXP02H39WD.11.57.F02.1.454.CMB.2.raw
  modified_base (413)..(413): a, c, t, g, unknown or other
  modified_base (456)..(456): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccaggccgggggggtccctggagactctcctgtctagtctctggattcgccttcagtgactatgccatgaagtgggtccgccaggctccgaggtaaggggctggaatggatttcatacattagcagtagtggtgcgacatatactacgcagactctgtagaagggccattcgatcatctaccganagacaagtggacaaacaactcaactgtactacgtaggtaaaanaccaaacacgtaccgtagaagacgacggaaggaacgtaccgggacgttacgtaaacgttaatttaagttcggtacgacggtacgacggtaccccccgtagggttaccgaacccggg

SEQ ID NO: 441671 - DNA, 553 bp, Homo sapiens
  misc_feature: GZ8MTXP02GRKJE.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttaccaacagaaacctggccaggctcccaggctcctcatctatgatgctagtttaggagggccacgtggcatccccaccaggttcagtgcagtgggtctggacagtactcattctcaccatccgacagcctagacgcctagaatatttgactagtttattactcgtacaacagtcgtagcagcacggccctcgggcgtacgtcggaccgaaacgggaccgaaggtaggaacgtacgaacggtacgaacgtggtacggctacgacaccgatcgtgtcttcactccttccgactactcg

SEQ ID NO: 441672 - DNA, 533 bp, Homo sapiens
  misc_feature: GZ8MTXP02HDXTW.11.57.F02.1.454.CMB.2.raw
  modified_base (239)..(239): a, c, t, g, unknown or other
  modified_base (256)..(256): a, c, t, g, unknown or other
  modified_base (286)..(286): a, c, t, g, unknown or other
  modified_base (348)..(348): a, c, t, g, unknown or other
  modified_base (403)..(403): a, c, t, g, unknown or other
tcagcgagagataccacgaccggtgctcgatttagctcgatatagttgggtttgggggcagggtgtactacctgtggttctcggggctgccctttggctttggagatggttttctcgatgggggctgggagggctttgttggagaccttgcacttgtactccttgccattcagccagtcctggtgcaggacgtgaggacgctgaccacacggtacgtgctgttgtactgctcctcccgngctttgcttggcattangccacctccacgccgtccacgtaccagttnaacttgacctcaggtcttcgtgctcaccgtccaccaccacgcatgtcaccctgaggggtccncaggcctcccgaggtaagggctggaatggatttcatacattagctagtagtggtnacgaccatatactaacgcagactactgtgaaggccgattcattcatctacagaagacaagtggaccaacaactcactgtatacgtagaaaactacaacagaccaagagacgacgaaggacacggtactag

SEQ ID NO: 441673 - DNA, 682 bp, Homo sapiens
  misc_feature: GZ8MTXP02GY4SS.11.57.F02.1.454.CMB.2.raw
  modified_base (399)..(399): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttccaacagaaactggccaggctccagctcctcatctatgatgactagtttaggacgggccacgtggaccactcccccaaccgtagggttccaggtcgggcgtaggtggggtctcggggaactagtacctttcgactttaccncctacccacgttcccgaccgacgtcccgttaagacgtcccgttaagaaagttaatttttcgaccgttaagttttaacttacgttgtaaccaaacgtaggtaccgtaagccaagccgaacgggtcccttccgggaccggtaccggttccggaccgaaacggggaccgaaagggtggaaaacgtcgaaacggacggtaaaccgttggtacggactacggaccgtaccctaagttccgtaacgtttcccttactaccgttaccctttcccccgtactacgtttccg

SEQ ID NO: 441674 - DNA, 576 bp, Homo sapiens
  misc_feature: GZ8MTXP02H6NAV.11.57.F02.1.454.CMB.2.raw
  modified_base (287)..(287): a, c, t, g, unknown or other
  modified_base (384)..(384): a, c, t, g, unknown or other
  modified_base (394)..(394): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaaacaactacttagcctgttacaacagaaacctgcagctccagctcncatctatgatgctagtttaggagggtccaacgtcggcactccccaacccgtaggtttccaggtggcaggtcggggtctaggggacagacttcattcncaccatccgnacgcctagactccagaagtatttgactagtttaattactagtacaaacagtacgtaagcagcgacggtcctccggacgtacgttcggaccgaagggaaccgaagggtagaagtacgaaagacgaaacgtggacgcgtcgaccaacctatctgttcttactacttcctaccccgctaattccg

SEQ ID NO: 441675 - DNA, 505 bp, Homo sapiens
  misc_feature: GZ8MTXP02GHRN5.11.57.F02.1.454.CMB.2.raw
  modified_base (353)..(353): a, c, t, g, unknown or other
  modified_base (362)..(362): a, c, t, g, unknown or other
  modified_base (372)..(372): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccggggggtccctgagactctcctgtctagtctctggattcgccttcagtgactatgccatgaagtggtccgcaggctccgaggtaaggggctgggaatggatttcatacattagcagtagnggtgcgacntatactacgnagactctgtgaggccgatcatcatctcagagacaatggacaacaactcactgtatactaggaaatcaaacagccgtagagacgtcgaggacacggctagtatattatgtgacgagacgcccctaggctaccgg

SEQ ID NO: 441676 - DNA, 701 bp, Homo sapiens
  misc_feature: GZ8MTXP02J3HR2.11.57.F02.1.454.CMB.2.raw
  modified_base (204)..(204): a, c, t, g, unknown or other
  modified_base (252)..(252): a, c, t, g, unknown or other
  modified_base (274)..(274): a, c, t, g, unknown or other
  modified_base (281)..(281): a, c, t, g, unknown or other
  modified_base (391)..(391): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctctgcaggccagtacaaatataacactatagcctgtcaanagaactgccaggctccagctcncatctangatgctagtttaggacgggccacgtggcacgtccccaccgtaggttcaggttcggcctaggtcgggtctcggggactagtacttacgtattcctacaccaattccccggnaacgtccctaagacgtacccgtagtaaacgtttatttacgtacgtttaacgtttaacttacgtacgtaaccgtaaacgtaacgggtacgtacgaccgacggacccgtaccgggtccccgtaccggggtaccggttaccggttacccgggaaacccggtaaacgggtaaccggtaacggggtaacggaaaccgtaacggaacgtaaccggtaacggttcggtacggtacctacggaccctacccgttaacgttcccgttaacgttacccgttacctacccgtttccccgtaccccgtaccttacgtttacg

SEQ ID NO: 441677 - DNA, 538 bp, Homo sapiens
  misc_feature: GZ8MTXP02JR8FT.11.57.F02.1.454.CMB.2.raw
  modified_base (204)..(204): a, c, t, g, unknown or other
  modified_base (311)..(311): a, c, t, g, unknown or other
  modified_base (343)..(343): a, c, t, g, unknown or other
  modified_base (359)..(359): a, c, t, g, unknown or other
  modified_base (421)..(421): a, c, t, g, unknown or other
  modified_base (474)..(474): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaacagaaacctggcccaggctcccaggctcctcatctatgatgcatttaggngggccactgcatccccaccaggttcagtggcngtgggtctgggacagntttcattctcaccatccgcagcctagagcctgaagtattttgctagtttattactgtcaacnacgtagcagcaggcctccgggacgacgttccggaccgaacggggaccgaaggnggaaggtcaaaaggccgaaactgtacggctgcaccatctgtcttcactcctttcccgcccatcg

SEQ ID NO: 441678 - DNA, 580 bp, Homo sapiens
  misc_feature: GZ8MTXP02HTC3O.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtcctgagactctcctgtctagtctctggattcgccttcagtgactatgccatgaaggtcgggtcccgccgaggcctaccgagggtaaggggctagggaagtggtatttcgaatactatttacgcaagttacgtggtgccgacagtataactacgcagactcgtgtagaaggccgtatcgatcatcctaccaagacgacaagtggacaaacaactcactgtactcgtaagaaacgtacaaacgagaccgtagaacggtacgtacggaaggaccgacgggtactagttacttaagtttagttgtcgacggtacggacccgtacccccgtaggtacgtacccgg

SEQ ID NO: 441679 - DNA, 606 bp, Homo sapiens
  misc_feature: GZ8MTXP02JCUOR.11.57.F02.1.454.CMB.2.raw
  modified_base (375)..(375): a, c, t, g, unknown or other
  modified_base (377)..(377): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcacctctcctgcagggccagtcaaaatattaaacaactacttagcctggttccaacagaaacctggccaggctcccaggctcctcatctatgatgctagtttaggagggccagtggcactccccaccagggttcaggtggctaggtggtctgggacagtacttcattccncnccactcccgcacgtccctaagactcctagaagtattttgacttagtttattactgtacaacgagtcgtagcgtaagccgtacggcccgttacccgggcggtaccggttcccgggaccgaacggggacccgaaaggggtcggaaacggtacgaaacggcggtaaacgtggtcgggtcctacggccaacccgtatccgtcgttccttacacttcctttcccgctacttccg

SEQ ID NO: 441680 - DNA, 551 bp, Homo sapiens
  misc_feature: GZ8MTXP02I71Y1.11.57.F02.1.454.CMB.2.raw
  modified_base (371)..(371): a, c, t, g, unknown or other
  modified_base (373)..(373): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgcagtttaggagggccatggcactccccaccaggttcaggtgcaggtggtctggggacagacttcattcncnccatccgcacgcctagcgacctgaagtatttgactagtttattactgtacaacgagacgtagcagcaggcctcggcgacgtcggaccgaagggaccaagggtaggaagtacgaacgcgaagtggtacggctaggccaacctagtctaagttccttacgacttccttcccgactattcg

SEQ ID NO: 441681 - DNA, 616 bp, Homo sapiens
  misc_feature: GZ8MTXP02JPVAN.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggaggcttaggtccaggcccggggggtccctgagactctcctgtctagtctctggattcgccttcagtgactatgccatgaaggtcgggtccgccgaggctccgagggtaggggctaggaatggatttcatacattagctagtagtggtgacgacatactactacgacagtactctgtaggaaacggggtccctagttacatctaactcctaccaagaacgaccaaagtcggaacaaaccgaactccaacttgtaactacgtaaggtaaactaccgaaactacgacccgtagaacggtacggtacggaacggaacccgagggtacttacggttaacttaatttaagttggtacgacggtacggtacccgacccccggttaacgggtacgtaacccggg

SEQ ID NO: 441682 - DNA, 543 bp, Homo sapiens
  misc_feature: GZ8MTXP02IH3S2.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttcctgttgctattttagaaggtgtccagtgcgaggtgcaagtggtgcagtctgggggagcttagtccaggccggggggtccctgagactctcctgtctagtctctggattcgccttcagtgactatgccatgaagtggtccgcaggctccgaggtaaggggctaggaatggatttcatacattacgctagtagtggtgaccgacctagtactactacgacagtactctgtagaagggccgtatcatcatcctacagagacatggacaaacactcactgtatcgtagaactcaaacagtacctagagtaacgtacgaggacaccgggtctaggtaacttattaagttgtacgacgacgtaaccgcccccgtaggtcgtaccggg

SEQ ID NO: 441683 - DNA, 530 bp, Homo sapiens
  misc_feature: GZ8MTXP02IA3HJ.11.57.F02.1.454.CMB.2.raw
  modified_base (204)..(204): a, c, t, g, unknown or other
  modified_base (352)..(352): a, c, t, g, unknown or other
  modified_base (363)..(363): a, c, t, g, unknown or other
  modified_base (365)..(365): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctccaggctcctcatctatgatgcatttaggagggcatggcatcccaccaggttcagtggcagtggtctgggacngacttcattcncnccatccgcagcctaagcgcctagaagattttgctagtttattactgttacaacagcgtagcagcaggcctcggacgacgttcggcgaaagggaccgaaggtggaagtcgaaagcgaaacgtggtacggctcgcacctaatctgtcttcactccttcccgcactcg

SEQ ID NO: 441684 - DNA, 540 bp, Homo sapiens
  misc_feature: GZ8MTXP02JGSBT.11.57.F02.1.454.CMB.2.raw
  modified_base (204)..(204): a, c, t, g, unknown or other
  modified_base (235)..(235): a, c, t, g, unknown or other
  modified_base (373)..(373): a, c, t, g, unknown or other
  modified_base (424)..(424): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatnttaacaactacttagcctggttccaacagaaacctggccaggctcccagctcctcatctatgatgcatttaggagggccacgtggcactcccaccaggttcaggtggcaggtgggtctcggggacagcttcattctcnccatccgcagcctagacgcctagatatttgctagtttattactgtacaacngacgtagcagcacggcctccggcgacgttcggaccgaacgggaccgaaggtaggaagtcgaaggacgaaacgtggtacggctcgacaccgatctgtctcactcctccgctacttcg

SEQ ID NO: 441685 - DNA, 537 bp, Homo sapiens
  misc_feature: GZ8MTXP02FJOET.11.57.F02.1.454.CMB.2.raw
  modified_base (262)..(262): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggcccaggctcccaggctcctcatctatgatgcatttaggagggccatggcatcccaccaggttcagtgcagtggtctgggacagacttcattctcaccatccgcacgcctagagccctgaagtattttgctagtttattactgtacaacagcgtagcagcgaggcctccggcgacgttccggaccgaagggaccgaagggtggaaagtcgaaagcgaacgtgtacggctacggcaccgatctgtcttacactcttcccgcacttcg

SEQ ID NO: 441686 - DNA, 510 bp, Homo sapiens
  misc_feature: GZ8MTXP02I8KIT.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttcctgttgctattttagaaggtgtccagtgcgaggtgcaagtggtgcagtctgggggaggcttagtccaggccggggggtccctgagactctcctgtctagtctctggattcgccttcagtgactatgccatgaagtggtccgcaggctccgaggtaggggctggaatggattcatacattagcagtagtggtgcgacatatactacgcagactctgtagaggccattcatcatctaccagagacaagtcgacaacactcactgtatcgagaaatcaacacgctagagacgtacgaggacacggctagtatattatgtcgacgacgaccgcccccgtaggtcgtaaccgg

SEQ ID NO: 441687 - DNA, 569 bp, Homo sapiens
  misc_feature: GZ8MTXP02ITFGD.11.57.F02.1.454.CMB.2.raw
  modified_base (364)..(364): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaaggtggtgcagtcgtgggggagcttagtccgaggccggggggtccctgagactctcctgtctagtctctggattcgccttcagtgactatgccatgagtggtccgcaggctcgaggtagggctggatggatttcatacattacgcagtagtggtgccgaacngtactactacgcagtactctgtagaggccgatcatcatcctacagagacagtcgacaacaactctactagtaactcgtaggtaaactacaaacgacgacctaggaagtacggtacggaacggacgaaccggggttacttagttacttaagtttacgttgtacgtacggtacgtacccggtaccccggttacgggtaccgtaccgg

SEQ ID NO: 441688 - DNA, 588 bp, Homo sapiens
  misc_feature: GZ8MTXP02I2A6N.11.57.F02.1.454.CMB.2.raw
  modified_base (204)..(204): a, c, t, g, unknown or other
  modified_base (262)..(262): a, c, t, g, unknown or other
  modified_base (436)..(436): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctcctcatctatgatgcatttaggagggccatggcatccccaccaggttcagtgctagtgggtctggggacagtacttcattcctcacctatcccgcacgcctagacgtcctagaagtattttgctaagttttacttactgttacaaacgngacgtagctagcacgggtccctccgggcgtaccgttccgggaccgaaaggggaccgaaagggtggaaacgtcgaaaggacgtaaacgtggtcgggactcggccaacccgtattccgtgttaccttctacttccctttcccggctaactttcg

SEQ ID NO: 441689 - DNA, 643 bp, Homo sapiens
  misc_feature: GZ8MTXP02H5TZ1.11.57.F02.1.454.CMB.2.raw
  modified_base (203)..(203): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaaacaactacttagccttggtaccaaacagaaacctggacccaggcctcccaggcctcctcatctatgatgctagtttaggagggccatggcactccccaccgtaggttcaggtggctaggtcgggtctggggactagtacttcatttctcacctagtcccgcaacgccctagacgtccctagaaagtattttgacttaaggtttactttactgtacaacagtcgtagactagcgacgggtccttacccgggcgtaccggttccggaccgaaaggggacccgaaaggggttcggaaagtcgaaaacggcggtaaaacgttcgggtacggccgttacggacccgtaaacccgtattaccgttaacgttaccttaccgtacgttccccgttacccgtacctacgttcg

SEQ ID NO: 441690 - DNA, 673 bp, Homo sapiens
  misc_feature: GZ8MTXP02IA3NI.11.57.F02.1.454.CMB.2.raw
  modified_base (285)..(285): a, c, t, g, unknown or other
  modified_base (354)..(354): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacgtcacctctcctgcagggccagtcaaaatattaacaactattagcctggttccaacagaaacctggccaggctccaggctccncatctatgattgctagtttaggagggtccactggcactccccacctaggttcagtggctaggtgggtcncggggacagtacttcatttctcaccatccgctacgcccttaaggacgcccgtagtaaagtatttttacggacttaacggttttaactttaacgttcgttaaccaaacgtacgtacgttagaccgtagccgaacgggtcccgtacccgggtacggtaccgggttacccggaaccggaaacggggtaacccgtaaaaggggttcggaaacggtaccgaaacggaccgtaaaccgttggtacggtccgttacggaccaacctacgttaccgttaacggttccttacgtaacctttaccgtttcccccggacttactttaccg

SEQ ID NO: 441691 - DNA, 602 bp, Homo sapiens
  misc_feature: GZ8MTXP02HBIJJ.11.57.F02.1.454.CMB.2.raw
  modified_base (204)..(204): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaacaactacttagcctggttccaacagaacctggccaggctcccaggctcctcatctatgatgcatttaggagggccacgtggacactccccaccaggttcagtcggctaggtgggtctgggacagacttcattcncaccatccgcacgccctaagacgtccctagaagtattttgactagttttaattacttgttacaaactagacgttagacgagacgacggtcccgtccgggacgtaccggttccggaccgaaacggggacccgaagggtacggaaacgtacgaaacggacgaaacgtggtacggacgtcggactaccgattcgtaagttccttactacttcccgttcccgctaacttccg

SEQ ID NO: 441692 - DNA, 527 bp, Homo sapiens
  misc_feature: GZ8MTXP02GEXZG.11.57.F02.1.454.CMB.2.raw
  modified_base (204)..(204): a, c, t, g, unknown or other
  modified_base (262)..(262): a, c, t, g, unknown or other
  modified_base (367)..(367): a, c, t, g, unknown or other
  modified_base (420)..(420): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggcaggctccaggctcctcatctatgatgcatttaggagggccactggcatcccaccaggttcagtggcagtggtctggggacagacttcattctcnccatccgcagcctagagcctagaatactttgctagtttattactgtctaaacngcgtagcagcaggccgtcgcgacgtcggcaagggaccgaaggtggaagtcgaacgcgaacgtggtcgacgtgccacatcgtgttcttcacttctcccgctacttccg

SEQ ID NO: 441693 - DNA, 555 bp, Homo sapiens
  misc_feature: GZ8MTXP02FQSMI.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtcaaaatattaaacaactacttagcctggttccaacagaaacctggccaggctcccaggctcctcatctatgatgcatttaggagggccactggcatccccaccaggttcagtggcaggtggtctgggacagacttcattcctcaccatcccgcacgccctaagcgcctagaacgtatttgactagtttattactgttacaactgacgtagcagcacggcctccgggcgtacggttccgaccgaagggaccgaagggcggaaagtcgaaacgcgaacgtggtcgactcgaccacatctcgtcttcacttccttcccgacctacttcg

SEQ ID NO: 441694 - DNA, 738 bp, Homo sapiens
  misc_feature: GZ8MTXP02FSY8T.11.57.F02.1.454.CMB.2.raw
  modified_base (264)..(264): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaacaactacttagcctggttaccaanagaaacctgccaggctccagctctcatctatgatgactagtttaggacgggccagtggccactccccgaccctagggttccaggttcggacagggtgggtctcggggacacgtactttcactttctaccacctactcccggactaacgcccttaaagacgacccgttagtaaagttacgtttttagacttaagtttttaatttaccgtaggttaacccaaacgtacgtacgtaacggtaccgaacggaccgaaccgggtcccgttacccggggaccggttaaccggttaccccggggaaccggtaaaacgggggaaccccgtaaaagggggttaccggaaaacgttaccgaaaacgggtaccggtaaaaccggttgggttaacggggccgttacgacccgtaaaccctgttacccggttcgtttccgtttaacgacccgtttcccctttaccccggacccttacgtttacccgg

SEQ ID NO: 441695 - DNA, 543 bp, Homo sapiens
  misc_feature: GZ8MTXP02F9XCD.11.57.F02.1.454.CMB.2.raw
  modified_base (203)..(203): a, c, t, g, unknown or other
  modified_base (416)..(416): a, c, t, g, unknown or other
  modified_base (430)..(430): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccacgtggcatcccaccaggttcagtgcagtggtctgggacagacttcattctcacctatcccgcacgcctaagacgcctagaagattttgctagtttattacngttcaacagcgtanccagcacggcctccgggacgtacgtttccggaccgaacgggaccgaaagggttggaagtacaacggtcaaacgtgtacgggctgcaccatctgtctcactcttcccgctatcg

SEQ ID NO: 441696 - DNA, 592 bp, Homo sapiens
  misc_feature: GZ8MTXP02H6CYK.11.57.F02.1.454.CMB.2.raw
  modified_base (368)..(368): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccgaggccgggggggtccctggagactctcctgtctagtctctggattcgccttcagtgactatgccatgaagtgggtccgcaggcctccgagggtaaggggctagggaatgggatttcatactatacgctagtagtggtncgacatactactacgcagctctgtagaacgggccgtattcatcactctaccaagagacaaagtgacaaacgtactcacttagtactcgtaaggaaaacttcaaacgtacgaccgtaggaacggtacggtacggaagggaaccacggggtcttaggttaactttaagttaagttcggtacgaccggtaacggacccgtaccccccgttagggtaacggtccccgg

SEQ ID NO: 441697 - DNA, 568 bp, Homo sapiens
  misc_feature: GZ8MTXP02JCJMD.11.57.F02.1.454.CMB.2.raw
  modified_base (371)..(371): a, c, t, g, unknown or other
  modified_base (373)..(373): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgcatttaggagggccactggcactcccacccaggttcagtggcagtggtctggggacagacttcattccncnccatccgcacgcctagacgccctagaatacttttgactagttttattactgtacaacagcgtagcagcgacggccctccgggacgtacgttccgggaccaacggggaacgaagggtaggaaagtacgaaacggacgtaaacgtggtacggctcgccgacctatctcgtcttacgacttccgttcccgctacttcg

SEQ ID NO: 441698 - DNA, 568 bp, Homo sapiens
  misc_feature: GZ8MTXP02IJFM8.11.57.F02.1.454.CMB.2.raw
  modified_base (250)..(250): a, c, t, g, unknown or other
  modified_base (260)..(260): a, c, t, g, unknown or other
  modified_base (368)..(368): a, c, t, g, unknown or other
  modified_base (370)..(370): a, c, t, g, unknown or other
  modified_base (537)..(537): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttanctgttccaanagaaacctgcagctccagctctcatctatgatgctagtttaggagggccacgtggccatccccaccgtaggttcagtggcaggtgggtctggggacagacttcattcncnccatccgcacgcctagacgtccctagaagtattttgacttagtttattacgtcgttacaaacgtagacgtagctagcgacggtcccgtccgggacgtaccggttccggaccgaacggggaccgaagggtggaacgtcgaagacgtaacgtggcggctcgacaacgtntctcgttcttctacttcgtccgtcctatacg

SEQ ID NO: 441699 - DNA, 554 bp, Homo sapiens
  misc_feature: GZ8MTXP02IU511.11.57.F02.1.454.CMB.2.raw
  modified_base (260)..(260): a, c, t, g, unknown or other
  modified_base (371)..(371): a, c, t, g, unknown or other
  modified_base (391)..(391): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagctggttccaanagaaacctggccaggctcccaggctcctcatctatgatgctatttaggagggccagtggcactccccaccctaggttcagtggcaggtgggtctgggacagacttcattcncaccatccgcagcctagacncctgaatatttgctagtttattactgtacaactagcgtagacagcacggtccgtccggacgtacgttccggaccgaagggaccgaaggtggaaagtacgaacgacggaactggtcggcgtacgccaactcttcgtcgttctactactccttacccgctactcg

SEQ ID NO: 441700 - DNA, 530 bp, Homo sapiens
  misc_feature: GZ8MTXP02HCHJ3.11.57.F02.1.454.CMB.2.raw
  modified_base (351)..(351): a, c, t, g, unknown or other
  modified_base (499)..(499): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggtctttgtcttggcattatgcacctccacgccgtccacgtaccagttgaacttgacctcaggtctcgtggctcacgtccaccaccacgcatgtcgacctcgacggggtccnccaggctcccgagggtaggggctggaatggatttcatacattagcagtagtgtcacgacatatactacgcagactcgtgagacggcgattcactcatccaccagacacaagtcgacaacactcgtactgtatacgtagaaactcaacngctaagagacgtacggagacgacggtcttag

SEQ ID NO: 441701 - DNA, 588 bp, Homo sapiens
  misc_feature: GZ8MTXP02FU9UL.11.57.F02.1.454.CMB.2.raw
  modified_base (263)..(263): a, c, t, g, unknown or other
  modified_base (294)..(294): a, c, t, g, unknown or other
  modified_base (330)..(330): a, c, t, g, unknown or other
  modified_base (368)..(368): a, c, t, g, unknown or other
  modified_base (370)..(370): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtcaaaatattaacaactacttagcctggttccaanagaaacctgccagctccaggctctcatctangatgctagtttaggaggccacgtggcactcccaccnggttcaggtggcaggtggtctgggacagacttcattcncncctatccgcacgccgtagacgtcctagaagtatttgacttagtttattactgtacaactagtacgtagacgagcgacggccgtcggacggtacgttaccggacgaacggggaccgtaaagggtcggaacgtacgaaaggacggtaacgtggtcggacgtcggtaccacctattcgtaacggttaccttcgtacttcccgtacccgtactacgtttccg

SEQ ID NO: 441702 - DNA, 661 bp, Homo sapiens
  misc_feature: GZ8MTXP02HJKJM.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatattaaacaacttacttagcctggttaccaacagaaacctggccaggcctcccaggctcctcatctatgatgctagtttaggacgggccacgtggcactccccaaccgtaggtttccaggtcggcgtaggtggggttcctaggggaccagtaccttcgatttccacaccacttccgcacgccctagacgtcctagaagtatttgctagtttattactgttacaacgtagctaagcaagtcgacggtaccctccgggacgtaccggttaccggaccgaaacggggtaccaaggggttacggaaacgtacgaaaacggacgaaacggttcggtacggccgttacggaccgtaaaccccgttacgtttaccgttccgtttaccctttacccgtaccgtttcccccgttaccccgtaccttaacgttccg

SEQ ID NO: 441703 - DNA, 626 bp, Homo sapiens
  misc_feature: GZ8MTXP02JKV0G.11.57.F02.1.454.CMB.2.raw
  modified_base (391)..(391): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctcccaggctcctcatctatgatgctagtttaggagggccagtggcactccccaccgtaggtttcaggtggactaggtcgggtctcggggacaggtacttcacgttcctacncctatcccgtacacgcctaaggacgtccctagtaaagttattttcgacttaagttttaacttactgtaactaacgtagtacgtagcagccgacggtcccgtaccgggaccgtacggttccggaaccgaaggggacccgaaagggtcggaaacgtacgaacggacgtaaacgtggtacggcttacggccaaccgtagtctggtaccttcgtacttccgttcccgactacgtttccg

SEQ ID NO: 441704 - DNA, 542 bp, Homo sapiens
  misc_feature: GZ8MTXP02JCXT4.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggatccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaacaactacttagcctggttccaacagaacctggccaggctcccaggctcctcatctatgatgctatttagggaggccacgtggcactccccacccaggttcagtggcaggtggtcctgggacagtacttcattctccacactccgacagcctaagacgtcctagaacgtattttgcttaagtttatactgtacaacagtcgtagcagcaggtccctcggcgacgtcggacgaggtaacgaggtagagtcgaagtcgaacgtggagcgtcgccacgatcgtgtcctcgacttccttccgctacg

SEQ ID NO: 441705 - DNA, 600 bp, Homo sapiens
  misc_feature: GZ8MTXP02JWWV7.11.57.F02.1.454.CMB.2.raw
  modified_base (373)..(373): a, c, t, g, unknown or other
  modified_base (432)..(432): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcactccccacccaggttcagtggcaggtgggtctggggacagacttcattctcnccatccgcagccctagacgccctagaagtatttgctagttttacttactgttacaaacngcgtagacgagcgacggccctcccgggcggtaccggttccggaccgtaaacggggacccaaggggtaggaacgtacgaaacggaccggaaacgtggttacggacttcggacctaccgacttcgtaacggttctttaccacgtttcccttaccccgtacctacttaccg

SEQ ID NO: 441706 - DNA, 584 bp, Homo sapiens
  misc_feature: GZ8MTXP02JQE5H.11.57.F02.1.454.CMB.2.raw
  modified_base (260)..(260): a, c, t, g, unknown or other
  modified_base (283)..(283): a, c, t, g, unknown or other
  modified_base (381)..(381): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatataacaactacttagcctggtccaanagaactggcaggctccagctccncatctatgatgctagtttagggagggcctacgtggcacgtcccccacctagggttcaggtcggcgtaggtgggtctggggacagtacttcattccacnccctatccgcacgcctagacgcctagaacgtatttgacttagtttattactcgtactaacgagcgtagcagcgacggcccgtccggcggtaccgttcggaccgaacgggaccgaagggtcggaagtacgaaggacgtaacgtggcggcgtacgccgaccgtagttcgtaacgttccttacgacttccgttccccgactactcg

SEQ ID NO: 441707 - DNA, 531 bp, Homo sapiens
  misc_feature: GZ8MTXP02I5FQ9.11.57.F02.1.454.CMB.2.raw
  modified_base (431)..(431): a, c, t, g, unknown or other
  modified_base (446)..(446): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtcctgagactctcctgtctagtctctggattcgccttcagtgactatgccatgagtggtccgcaggctccgaggtaaggggctggaatggtattcatacattagcagtagtggtgcgaccatatactacgcagactcgtgtagaagggcccatacatcatcctacagagactagcgacaacactcactgtanctaggaaatacaacngactgagacgtcggagacacggcttaggtaacttagtttaacgtgtacgacgtaacggacccgacccccgtaggtcgaacccggg

SEQ ID NO: 441708 - DNA, 637 bp, Homo sapiens
  misc_feature: GZ8MTXP02GI2W5.11.57.F02.1.454.CMB.2.raw
  modified_base (471)..(471): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttccaacagaaacctggccaggctcccaggcctcctcatctatgatgctagtttaggagggtcccagtggacactccccaccgtaggttcaggtggcgtaggtcggggtactcggggaactagtactttcgtattcctaccaccctacttcccgacaccgtccctaggacgtccctagtaagtattttgacttaagttttatacctgtacaacgngtacgtagcagcgacggtcccgtcgggacgtaccggtccgacggaacgggaccgaagggtaggaagtacgaacggtacggaacgttggtacgggctacgggaccaacccgtattccgtaacgttccttacgtaccgttcccgtttacccgaccgttacgtttccgg

SEQ ID NO: 441709 - DNA, 549 bp, Homo sapiens
  misc_feature: GZ8MTXP02GLDPD.11.57.F02.1.454.CMB.2.raw
  modified_base (354)..(354): a, c, t, g, unknown or other
  modified_base (416)..(416): a, c, t, g, unknown or other
  modified_base (509)..(509): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgtgtactgctcctccgcgctttgtcttggctattatgccacctccacgcccgtccacgtaccagttgaacttgacctcagggtcttcgtggctcacgtccaccaccacgcatgtcgacctcgacggggtcccnccacggcctaccccgagggtaaggggctagggaatggatttcatacattagcagtagtggtncgaccatatactacgcagactctgtgaagggccgtattcatcatctccagagacaatcggacaacactcactgtatcgtaggaaactcgaacncgaccgtaagaagacgtacggacggaaccgacggtctaag

SEQ ID NO: 441710 - DNA, 573 bp, Homo sapiens
  misc_feature: GZ8MTXP02JAH0F.11.57.F02.1.454.CMB.2.raw
  modified_base (468)..(468): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctatttagaaggtgtccagtgcgaggtgcaagtggtgcagtcgtgggggagcttagtccgagggccggggggtccctgagactctcctgtctagtctctggattcgccttcagtgactatgccatgaaggtcggtccgccgaggctccgagggtaagggctaggaatggattcatacattacgctagtagtggtgcgacatactactacgcagactcgtgagaacggctatcatcatcctacgaagacacagtacggacaaacgactctactagtactacgtaagtaaactacgaaacncgaccgtagaacgaggtacggaaaggaccgtaacggtcttacggtaacttaagttagttcggtacggacgtacggtacccgtccccgtaacgggtcgtacccggg

SEQ ID NO: 441711 - DNA, 688 bp, Homo sapiens
  misc_feature: GZ8MTXP02F6B4D.11.57.F02.1.454.CMB.2.raw
  modified_base (265)..(265): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtacaaaatattaacaactacttagcctggttaccaanagaaacctgccaggctccaggctcctcatctatgatgctagtttaggacgggccacgtggaccactccccgaccgtacggttcgaggtcggcgtaggtcggggtcgtacggggactacggtacttactacgtttcctacaccctactccggacacgcctagacgcctagtaacgttagtttgacttagtttaattacgtagttaaccaaacgtagtacgtacgacgaacgcgaacgggtcccgtcccgggaccggtacggttaccggaaccggaaacggggaacccgtaaaggggtaggtaaacggtacgtaaaacgggaccggaaaccgttgggtcggttaccgacggtaccctaacccgtaacgtttccgttaacgttaccgtttacctaccttcccgttaccccgtcctaacgtttaccg

SEQ ID NO: 441712 - DNA, 609 bp, Homo sapiens
  misc_feature: GZ8MTXP02G009K.11.57.F02.1.454.CMB.2.raw
  modified_base (293)..(293): a, c, t, g, unknown or other
  modified_base (299)..(299): a, c, t, g, unknown or other
  modified_base (373)..(373): a, c, t, g, unknown or other
  modified_base (385)..(385): a, c, t, g, unknown or other
  modified_base (438)..(438): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttaccaacagaaacctggccaggcctcccaggctcctnatctangatgcagtttaggaggccagtggcactccccaccgaggttcagtgcaggtggtctggggacagacttcattccncaccatcccganacgcctaagcgaccctagaaagtattttgacttaagtttaattactgtacaanagtacgtagacagcgacggtccgtcggacggacggttccggaccgaaacggggaccgaagggtacggaaacggtacaaacggacggaaaacgttgggtacggtcgtacggaccgaacctagttccgttcgttaccttactaacttcccgtttaccccgacctactttaccg

SEQ ID NO: 441713 - DNA, 702 bp, Homo sapiens
  misc_feature: GZ8MTXP02I85T8.11.57.F02.1.454.CMB.2.raw
  modified_base (262)..(262): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgcatttaggaggccactggcatcccaccaggttcagtcggcgtaggtcggtcggtaccgacgacgttctacttcttccgacccactccgtcccgacgtacccgtaccgtaagaccgttacgtaaagtaacgttttagttacgtaacgtttaagttttaaccttagttaccgttaaacgaacgttacgtacgtactacggacgtaacggcccggttacccggaccgggtaccgggttaaccggttcccggaaacgggaaccggtaaaccgggtaaagggtacggtaaccgacgtaacggaaacgtacggtttacggcggttacggaccgaccctaacgttaccttaacggttcgttaccgttaacttacccgtttcccgtacccggttaacctacgtttaccg

SEQ ID NO: 441714 - DNA, 513 bp, Homo sapiens
  misc_feature: GZ8MTXP02HJ88V.11.57.F02.1.454.CMB.2.raw
  modified_base (262)..(262): a, c, t, g, unknown or other
  modified_base (358)..(358): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaanagaaacctggccaggctcccagctctcatcatgatgcatttaggaggtccatggcatcccaccagtcagtgcagtggtctggacagacttcattcncaccatccgcagcctagacgcctagaagtattttgctagtttattactgtacaaacagcgtagacagcaggcctcggcgacgtcgacgaaggaccgaaggtagaagtacgaagcgaactgtgctagcaccatctaagtctcactctcccgcatcg

SEQ ID NO: 441715 - DNA, 606 bp, Homo sapiens
  misc_feature: GZ8MTXP02JQLMZ.11.57.F02.1.454.CMB.2.raw
  modified_base (283)..(283): a, c, t, g, unknown or other
  modified_base (362)..(362): a, c, t, g, unknown or other
  modified_base (382)..(382): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatataacaactacttagctgtccaacagaacctgcaggctcccaggctccncatctatgatgctatttaggaggccagtggcactccccaccaggttcagtgctagtgggtctgggacagacttcattcncaccatccgcacgcctagcncctagaagtatttgctagtttattactgtacaacgtagacgtagacagtccgaacggcccgtccggacggtaccggttcggaccgtaacggggaccgaaggggtacggaacgtacgaacggtacggtaacgtacgggttacggcgtacggacctaccgtacgttaccgttaacggtttcccttacgttaaccttcccgttcccccggtaccttaacgtttccgg

SEQ ID NO: 441716 - DNA, 541 bp, Homo sapiens
  misc_feature: GZ8MTXP02ICRX2.11.57.F02.1.454.CMB.2.raw
  modified_base (353)..(353): a, c, t, g, unknown or other
  modified_base (407)..(407): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggcttttgttggagaccttgcacttgtactccttgccattcagccagtcctggtgcaggacggtgaggacgctgaccacacggtacgtgctgttgtactgctcctcccgcggtcttttgtcttggctattatgcacctccacgccgtccacgtaccagttgaacttgacctcaggtcttcgtgctcacgtccaccaccacgcatgtcgacctcgaggggtccncgaggctcccgaggtagggctaggaatggatttcatacattagcagtagtggtncgacatatactacgcagactcgtgtagaagggcctattcatcatcctaccagagacaagtcggacaaacactcactagtatacgtaggaaactcaaacacgacctaagacgacgtacgaggtacacggtcttag

SEQ ID NO: 441717 - DNA, 587 bp, Homo sapiens
  misc_feature: GZ8MTXP02JG37E.11.57.F02.1.454.CMB.2.raw
  modified_base (204)..(204): a, c, t, g, unknown or other
  modified_base (292)..(292): a, c, t, g, unknown or other
  modified_base (359)..(359): a, c, t, g, unknown or other
  modified_base (377)..(377): a, c, t, g, unknown or other
  modified_base (383)..(383): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtccaccctctcctgcagggccagtcaaaatattaaacaactacttagcctggttccaacagaaacctggccaggctcccagctcctnatctatgatgctatttaggagggccacgtggaccactccccacctagggttcaggtgcagtgggtcncggggacagcttcattcncacctntccgcagcctaagacgcctagaagtattttgacttagtttattacttgtacaacgtgacgtagcaagcgacggcccgtccggacggtaccgttccgggacccgaacggggaccgaaaggggtacggaacgtacgaaacggacgtaacgtggtacggctcgacgaccgatacgtcgtcttactacgtccttacccgctacgttcg

SEQ ID NO: 441718 - DNA, 542 bp, Homo sapiens
  misc_feature: GZ8MTXP02GO978.11.57.F02.1.454.CMB.2.raw
  modified_base (403)..(403): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtggtccgccaggctccaggtaaggggctgggaatggatttcatacattagcagtagtggtgcgacatatactacgcagactctgtagaagggccattcatcatccncagagacaatggcaaacactcactgtatctaggaaactcaaacgtacgcctaggaagtacggtaccggaagggaaccacgggtacctaggtaattatttaagtgtgacggtagaccgcccccgtacgggtcgaacccgg

SEQ ID NO: 441719 - DNA, 506 bp, Homo sapiens
  misc_feature: GZ8MTXP02F5R4S.11.57.F02.1.454.CMB.2.raw
  modified_base (357)..(357): a, c, t, g, unknown or other
  modified_base (362)..(362): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctatttagaaggtgtccagtgcgaggtgcaagtggtgcagtcgtgggggagcttagtccaggccggggggtccctgagactctcctgtctagtctctggattcgccttcagtgactatgccatgaagtgggtccgccaggctccaggtaaggggctggaatggatttcatacattagcagtagtggtncgacntatactacgcagactctgtgaaggccgattcatcatctcagagacaatggacaaacaactcactgtataccaggaaatcaaacagacctagagagtcgaggacacggctgtatattatgtgcgacgacgccccgtagtcgtacg

SEQ ID NO: 441720 - DNA, 603 bp, Homo sapiens
  misc_feature: GZ8MTXP02F3UT4.11.57.F02.1.454.CMB.2.raw
  modified_base (201)..(201): a, c, t, g, unknown or other
  modified_base (283)..(283): a, c, t, g, unknown or other
  modified_base (369)..(369): a, c, t, g, unknown or other
  modified_base (561)..(561): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctccagataccacggagaaattgtgttgacacagtctccggccaccctgtctgcgtctcctggggaaacngtcacctctcctgcagggccagtacaaaatattaacaactattagcctggttccaacagaacctggcaggctccagctcctnatctatgatgctagtttaggagggccacgtggccactccccaccgtaggttcaggtggcaggtggtctgggacagacttcattccnctaccgatcccgacacgcccgtaaggacgcctagaaacgttagttttcgacttagttttaactttactacgttacaaacgtagacgtaagacagaccgacggcccgtccggacggtacgttaccggaccggaagggaccgaaaggggtacgaaagtacgaaggtaccgaacgtggtacgcgtacggacaacnctactgtaccttacgaccttccgtttccccactacttaccgg

SEQ ID NO: 441721 - DNA, 733 bp, Homo sapiens
  misc_feature: GZ8MTXP02HQGAT.11.57.F02.1.454.CMB.2.raw
  modified_base (263)..(263): a, c, t, g, unknown or other
  modified_base (285)..(285): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaatattaaacaactacttagcctggttccaanagaaactgcaggctccagctcnatcatgatgctagtttaggagggccagtcggactactccccaaccccgtagggtttccaaggttcggaccgtagggtcggggttaccgtacggggtaacaacggtactttactaacttttcccgtacctacccgtaacttccccggaccaccgggtaccccttaagggaacgtccccgtaaggtaaagttacgtttttcggacctttaaggtttttaactttaacgttcgtttacaacggtactaagttaaacgttaaaggttaaacggttcggtacccgttcgtaccgtttaccgggtttcgggaacgggtacggggtaaaccgtaaggggttaggaaggaacttacggaacggtaaccgtaaaacggttggtacgggtacttcggacctaactacgttcttaacggttaccttactacgttcccgtttaccccgccttaattccgg

SEQ ID NO: 441722 - DNA, 619 bp, Homo sapiens
  misc_feature: GZ8MTXP02GHGYB.11.57.F02.1.454.CMB.2.raw
  modified_base (611)..(611): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctccaggctcctcatctatgatgcagtttaggacgggccacgtggaccactccccaacccgtagggttccaggttcggcgtaggtggggtctggggacagtacttcattccacaccatcccgcacgccctagacgcctagaacgtatttgactagtttattactcgtacaactagcgtagcgtagcgacggccgtccgggacggtaccggttccggaccgaacggggtaacccgtaaagggtacgggtaaacgtacgaaaggtaccggtaaacggtcggtacggacgtcggacctaacccgtattcgtaacgttcttacgacttccgtacccnctacttcg

SEQ ID NO: 441723 - DNA, 766 bp, Homo sapiens
  misc_feature: GZ8MTXP02JM60B.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttaccaacagaacctggccaggctcccaggctcctcatctatcgatgctatttaggacggggccacgtggaccacgtccccaccctagggttccaaggttcggccgaggttcggggtctcggggacaggtaccttcgactttcctccacccgtaacttcccgggactaccgcccgttaagaccgtcccgtagaaacgttagttttttacggacctttaaggtttttaactttaaccgttacggttactaaaaccgtacggtacgttaacgaccgtaaaggtcccggtaacgggccccgttcccggggtaacccgggtaccgggtttacccggggacccggtaaaacgggggaacccgtaaagggggtacgggtaaaacgggtacgaaaacggtaaccgggtaaaaccgttaggtcggggtaccggttaccggaccctaaacccgtacgttaccgttaacggttacctttcctaccggttcccctttacccccggtccctaacgtttcccgg

SEQ ID NO: 441724 - DNA, 540 bp, Homo sapiens
  misc_feature: GZ8MTXP02IMYOJ.11.57.F02.1.454.CMB.2.raw
  modified_base (357)..(357): a, c, t, g, unknown or other
  modified_base (368)..(368): a, c, t, g, unknown or other
  modified_base (370)..(370): a, c, t, g, unknown or other
  modified_base (386)..(386): a, c, t, g, unknown or other
  modified_base (396)..(396): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccagctcctcatctatgatgcatttaggagggccactggcatccccacccaggttcagtggcagtgggtctgggacngacttcattcncnccatccgcagcctagngcctgaagtntttgctagtttattactgtacaacagcgtagcaagcacggcctccggcgacgttcgacgaacgggaccaaggtggaagtcgaagacgaactggtagggctaggccaccgtatcgtaagttcttctactccttcccgctacttcg

SEQ ID NO: 441725 - DNA, 548 bp, Homo sapiens
  misc_feature: GZ8MTXP02GTMJ5.11.57.F02.1.454.CMB.2.raw
  modified_base (202)..(202): a, c, t, g, unknown or other
  modified_base (374)..(374): a, c, t, g, unknown or other
  modified_base (385)..(385): a, c, t, g, unknown or other
  modified_base (395)..(395): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgctatttaggagggccacgtggccatccccacctagggttcagtggcaggtgggtctgggacagtacttcatttcncaccatcccgnagtcctagcnccctgaagtatttgactagtttattacgtgttacaacgtagcgtagcagcacggcctccggacgaccgttcgaccgaaggaccgaaggtaggaagtcgaaggtcgaacgtggtcggctagccactatcgtgtcttcactcttacccgctatcg

SEQ ID NO: 441726 - DNA, 543 bp, Homo sapiens
  misc_feature: GZ8MTXP02HQ89D.11.57.F02.1.454.CMB.2.raw
  modified_base (258)..(258): a, c, t, g, unknown or other
  modified_base (348)..(348): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctcctggggaaacagtccacctctcctgcagggccagtacaaaatataacaactactagctgtcaanagaacctgcagctccagctctcatctatgatgactagtttaggaggccactggccatccccaccaggttcagtgcaggtggtctgggganagtcttcattcctcaccatccgctacgcctaagacgccctagaaagtattttacgactagttttattactgtacaactgcgtaagcacgcacggcctaccggcggacgttccggaccgaaagggaccaagggtagaagtcaagcgtaaacgtgtcgactcgacacctagtctgttctactactctcccgactatc

SEQ ID NO: 441727 - DNA, 522 bp, Homo sapiens
  misc_feature: GZ8MTXP02J0TLR.11.57.F02.1.454.CMB.2.raw
  modified_base (355)..(355): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccgggggggtcctgagactctcctgtctagtctctggattcgccttcagtgactatgccatgagtggtccgcaggctcgagtagggctgatggattcatacatagcagtagtggtgcgaccntatactacgcagctctgtagagggccgattcatcatctaccagacgacaatggacaacaactcactgtactcgtaggaaactcgaaacagccgtagacgacgtacggacgacgaaccggtctagtattagttagttgcgacgacgacccgacccgtacggtcgacgg

SEQ ID NO: 441728 - DNA, 563 bp, Homo sapiens
  misc_feature: GZ8MTXP02FJ9XY.11.57.F02.1.454.CMB.2.raw
  modified_base (353)..(353): a, c, t, g, unknown or other
  modified_base (364)..(364): a, c, t, g, unknown or other
  modified_base (373)..(373): a, c, t, g, unknown or other
  modified_base (420)..(420): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccagttcagtgcagtggtctgggacngacttcattcncaccatccnacgcctagacgcctagaagtatttgactagtttattactgtacaacngacgtagcagcacggcctccgggacgaccgttccggaccgaacggggaaccgaaaggggtaggaaacgtacgaaacgacggtaaacgtggtcgggactcggaccaccgactcgtcgtcttcacttccttcccgacctacttcg

SEQ ID NO: 441729 - DNA, 674 bp, Homo sapiens
  misc_feature: GZ8MTXP02GK6X9.11.57.F02.1.454.CMB.2.raw
  modified_base (263)..(263): a, c, t, g, unknown or other
  modified_base (393)..(393): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttaccaanagaaacctggacaggctcccaggctcctcatctatgatgactagtttaggagggccacgtggcactccccaccgtaggttcagtggctaggtgggtctggggacagtacttcattctacacctatccggntacgcctaagacgtcctagaagttacttttagacttaagtttattactcgttacaaacgaggtacgtaaggacaacgcgaacgggtccccttacccggggaccggttaaccggttaccggggaaccgtaaaacgggggaacccgaaaagggggttacgaaacgggttaccgaaaaggacggtaaaaccgtgggttacgggacttacggaccaacccggtaagttaccttaaggttccctttacgtaaccgtttcccctttacccggacccttaattaccgg

SEQ ID NO: 441730 - DNA, 543 bp, Homo sapiens
  misc_feature: GZ8MTXP02H3J3N.11.57.F02.1.454.CMB.2.raw
  modified_base (368)..(368): a, c, t, g, unknown or other
  modified_base (385)..(385): a, c, t, g, unknown or other
tcagcgagagataccacgaccggtgctcgatttagctcgatatagttgggtttgggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagccttggttccaacagaaacctggcccaggctccaggctcctcatctatgatgcatttaggagggccatggcatcccacccaggttcagtggcagtggtctggggacagacttcattctcncatccgcagccctagancctgaagatttgctagtttattactgttcaacagcgtagcagcagggcccttaccgggacgaagttccggccgaaagggaccaaagggtcggaagtacgaagcgaaactggtacgcgtacgccaacagtctaagtcctttcattcctcccgcctatcc

SEQ ID NO: 441731 - DNA, 605 bp, Homo sapiens
  misc_feature: GZ8MTXP02JFGSZ.11.57.F02.1.454.CMB.2.raw
  modified_base (259)..(259): a, c, t, g, unknown or other
  modified_base (265)..(265): a, c, t, g, unknown or other
  modified_base (353)..(353): a, c, t, g, unknown or other
  modified_base (360)..(360): a, c, t, g, unknown or other
  modified_base (406)..(406): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaatactagcctgtcaanagaacngcagctccagctctcatctatgatgcagtttaggaggcatgcactccaccaggttcagtgcagtggtctgggacagacttcattcacncatccgnacgcctagagcctagagtatttgactagtttattactgtacaaacngactagacacgacgacggccgttacccggaccggtaccggttaccggtaccgaaacggggaaacccggtaaacgggtaagggtaaaggtaaccgaaaggtaaccggtaaacggacggttacgggtacgtacgtaccgtaaccgtaacgttacgttaacgttacgttacttacttaccgttacccgtacccgtacttacg

SEQ ID NO: 441732 - DNA, 607 bp, Homo sapiens
  misc_feature: GZ8MTXP02IEK5L.11.57.F02.1.454.CMB.2.raw
  modified_base (369)..(369): a, c, t, g, unknown or other
  modified_base (391)..(391): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaacagaaacctgccaggctccaggctcctcatctatgatgcatttaggagggccatggcactccccacccaggttcagtggcagtgggtctgggacagtctcattccncacatccgctagccctaggacncctagtaagattttgctagtttattactgtacaaagagcgtagccaggaccaggtcccgtaccggtcggtaccgtttccgggaccgaaacggggtaccgaaaacggggttggaaaggttaccgaaaggaccggtaaaacgttggtcggaccgtaggacccaaccgttacttaccgttcgttacctttacgtaccttcccgttacccgcgttactcg

SEQ ID NO: 441733 - DNA, 506 bp, Homo sapiens
  misc_feature: GZ8MTXP02FM78H.11.57.F02.1.454.CMB.2.raw
  modified_base (359)..(359): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccggggggtccctgagactctcctgtctagtctctggattcgccttcagtgactatgccatgaagtggccgcaggctccaggtagggctggaatggatttcatacattacgcagtagtggtgcgacntatactacgcagactctgtgaggccgattcatcatctccagagacaatggacaaacactcactgtatctaggaaatcaaacagcctagacgtagtcgaggacacggctagtatattatgtgacgacgacgccccgtacggtcgtacg

SEQ ID NO: 441734 - DNA, 591 bp, Homo sapiens
  misc_feature: GZ8MTXP02ITZJF.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaaacaactacttagcctggttccaacagaacctggccaggctcccaggctcctcatctatgatgcatttaggagggccatggcatcccaccaggttcagtggcagtgggtctgggacagacttcattctcaccatcccgcacgcctagacgtcctagaagtattttgacgtagtttattactgtactaacagtacgtagtcagccgacggccgtacccgggcggtacccgttccggaccgaaacggggacccgaaagggtagggaaacgtacgaaacggacgtaaacgtgtcggggcttcggacctaaccacttcgtgttccttactacttcccgtttcccgcctaactttcgg

SEQ ID NO: 441735 - DNA, 570 bp, Homo sapiens
  misc_feature: GZ8MTXP02GE9P7.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccaatgcgaggtgcaagtggtgcagtcgtgggggagcttagtccaggccggggggtcctgagactctcctgtctagtctctggattcgccttcagtgactatgccatgaagtggtccgccaggctccgagggtaaggggctagggaatggtatttcatacattagcagtagtggtgacgactatatactacgcagactctagtagaacgggccgtattcatacactcctaccaagtagaactaagtacggaaccaaacaaccttacaacttagtaataccgtaaggaaaatacaaacacgacctagaagagtacgaaggacgacggtactagtaattatttaagtggtacgacgacgacccgtacccccgtacgggtcgaaccgg

SEQ ID NO: 441736 - DNA, 560 bp, Homo sapiens
  misc_feature: GZ8MTXP02GNP0N.11.57.F02.1.454.CMB.2.raw
  modified_base (204)..(204): a, c, t, g, unknown or other
  modified_base (262)..(262): a, c, t, g, unknown or other
  modified_base (366)..(366): a, c, t, g, unknown or other
  modified_base (435)..(435): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaaacctggccaggctcccaggctcctcatctatgatgctagtttaggaggggtccacgtggcactccccaccctagggttcagtggcagtgggtctgggacngtacttcattctcaccatccgcagcctagacgcctagaagtatttgactagtttattactgtactaacngcgtagcagcaggcctccgggcgtacgttccggacgaacggggaccaaagggtcggaagtcgaaaggcgaaacgtggtcgacgtcgaccacccatcgtgtcttacacttccttcccgactactcg

SEQ ID NO: 441737 - DNA, 534 bp, Homo sapiens
  misc_feature: GZ8MTXP02HO8T9.11.57.F02.1.454.CMB.2.raw
  modified_base (306)..(306): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccaggccgggggggtcctgagactctcctgtctagtctctggattcgccttcagtgactatgccatgaagtgggtccnccgaggctccgagggtaaggggctgggaatggtatttcatacattacgctagtagtggtgcgacatatactacgcagactctgtgaaggccgattcatcatctacagagacatggactaacaactcatgtatcaggaaactacaacagcctagacggacgtacgaggaccacggtctagtacttattagttcggtgacgtaggacccgccccgtaacggtcgtaccgg

SEQ ID NO: 441738 - DNA, 658 bp, Homo sapiens
  misc_feature: GZ8MTXP02JXMA0.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttaccaacagaaacctggccaggcctcccaggctcctcatctatgatgctagtttaggacgggccacgtggaccactccccaacccgtagggtttacaggttcggactaggtcggggtactcggggactagtacttcattcctcacctactccgcacgcctagacgtcctagaacgttatttgctagtttattactcgtacaaacgagtacgtacgacgtagacgacggtccgttacccggacgggtaacccggtttaccgggaacccggtaaacgggggaacccgtaaaggggttaaccgggaaacgttaccgaaacggaccggtaaaaccgttgggacggtcgtacggacctaccgaacttcgttaacgtctttacgacttccgttcccgacctacttccg

SEQ ID NO: 441739 - DNA, 539 bp, Homo sapiens
  misc_feature: GZ8MTXP02FTG41.11.57.F02.1.454.CMB.2.raw
  modified_base (278)..(278): a, c, t, g, unknown or other
  modified_base (391)..(391): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttnagtgactatcgccatgaaggtcgggtccgccaggctccgagggtaagggctgggaatggtattcatacattagcagtagtggtgcgaccatactactacgcagtactcgtagngaaaggccgattcatcatctaccagagacaatggacaaacaacctacactagttactcgtaggaaactcaaacagacctagagacgtcgaggacgacggtctagtatattagtgtgacgacgaccgtaccccgtacggtacgtaccgg

SEQ ID NO: 441740 - DNA, 723 bp, Homo sapiens
  misc_feature: GZ8MTXP02I2LCQ.11.57.F02.1.454.CMB.2.raw
  modified_base (296)..(296): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaacctggccaggctcccaggctcctcatctangatgctagtttaggacgggtccactggacactccccaccgacggttcagtggccgaggtgggtctcggggacaggtacttcgattcctacacctacgtcccgacgacgcccttaaggaccgtcccgttaaggaaagtttaagtttttaggtaccttaggtttttaaactttaaccgttcggttaacctaaacgaacggtaccggttaacggaccgtaaacggtccggaaccggggtccccgttcccggggacccgggtaacccggggtttaccccggggacccggaaaacgggggttaaccccggaaaagggggttacggggaaaacggttaccgaaaggtaccggtaaacgtcgggttacggccgttacgaccgtaccgtacttcgtcgttaccttctaacttcccgttcccgtacctacgttccg

SEQ ID NO: 441741 - DNA, 533 bp, Homo sapiens
  misc_feature: GZ8MTXP02JCPYB.11.57.F02.1.454.CMB.2.raw
  modified_base (239)..(239): a, c, t, g, unknown or other
  modified_base (506)..(506): a, c, t, g, unknown or other
  modified_base (511)..(511): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctccgnggctttgcttggcattatgccacctccacgccgtccacgtaccagttgaactgacctcagggtctcgtgctcacgtccaccaccacgcatgtcgacctcgacggggtcccaccgaggcctcccgagggtagggctaggaatggatttcatacagttagctaggttagtggtgacgaccatactactacgcagactcgtgagaagggccattcatcatctacagagacagtcgacaaactactcactgtatacgtagaaactcaaacntaccngagacgtcgagacacggtctag

SEQ ID NO: 441742 - DNA, 615 bp, Homo sapiens
  misc_feature: GZ8MTXP02F88TB.11.57.F02.1.454.CMB.2.raw
  modified_base (338)..(338): a, c, t, g, unknown or other
  modified_base (378)..(378): a, c, t, g, unknown or other
  modified_base (383)..(383): a, c, t, g, unknown or other
  modified_base (388)..(388): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtcaaaatattaacaactacttagcctggttccaacagaaacctggccaggctccaggctcctcatctatgatgctagtttaggagggccacgtggaccatccccacccgnggttcaggtggcaggtgggtctgggacagacttcattccncaccntccgnacgcctagacgcctagaagtactttgacttagtttattactgtacaacagacgtagcagcgacggtccgtccgggacgtaccgttccgggaccgtaaacggggacccgaaagggttaggaaacgtacgaacggtacggtaaacgtggtacggcgttacggccaaaccgtattaccgttcggttacctttaccgaacgtttcccttaccccggtacctacggtttccg

SEQ ID NO: 441743 - DNA, 574 bp, Homo sapiens
  misc_feature: GZ8MTXP02GLNF0.11.57.F02.1.454.CMB.2.raw
  modified_base (262)..(262): a, c, t, g, unknown or other
  modified_base (378)..(378): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctcccaggctcctcatctatgatgctagtttaggagggccactggccactccccacctaggttcagtggcaggtgggtctggggacagacttcattcctcnccactccgacacgcctagacgcctagaagttattttgcttagtttaattactgttacaaacgtagtcgtagcagcgacggtcctccggcgtacgtccggacgaagggaccgaagggtcggaagtcgaaggccgtaaatggtcggtctcggaccacgacgttactcgttccttcgacttccgtcccggctacgttcg

SEQ ID NO: 441744 - DNA, 617 bp, Homo sapiens
  misc_feature: GZ8MTXP02JBMS2.11.57.F02.1.454.CMB.2.raw
  modified_base (204)..(204): a, c, t, g, unknown or other
  modified_base (381)..(381): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatataaacaactacttagcctggttaccaacagaacctggccaggctcccaggctctcatctatgatgctagtttaggagggccacgtggccactccccacctaggttcaggtcggcaggtgggtctcggggacagtacttcattccncaccatccgcacgcctaggacgtcctagaacgttattttcgacttagttttattactgtacaacgtgtacgtagacgagacgacggtcccgtccgggcgtaccggttccggaccgaaacggggaaccgaaggggtaggaacgtacgaaacggtacggtaacgtgggtacggcgtacggacctacctacgttacgtcgttacctttacgacttcccgttaccccgacctaacttccg

SEQ ID NO: 441745 - DNA, 569 bp, Homo sapiens
  misc_feature: GZ8MTXP02I5SY2.11.57.F02.1.454.CMB.2.raw
  modified_base (302)..(302): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttcctgttgctattttagaaggtgtccagtgcgagtgcaagtggtgcagtcgtgggggagcttagtccaggccggggggtcctgagactctcctgtctagtctctggattcgccttcagtgactatcgccatgaagtggtccncaggctccgaggtaaggggctggaatggatttcatacattacgcagtagtggtgaccgaccagtactacacgcagactctgtaggaacggccgtattccatcagtcctaccagagacagtacggacaaacacttcacgtagtactaccgttaaggaaacttcaaaacgtcgaccgtaggaacgaacgtcggaaacggacgacgggtacttagtaaacttatttaagtgtacgacgtacggacccgtcccccgtaggtacgtacccgg

SEQ ID NO: 441746 - DNA, 576 bp, Homo sapiens
  misc_feature: GZ8MTXP02F3VV2.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccaggccggggggtccctgagactctcctgtctagtctctggattcgccttcagtgactatgccatgaagtggtccgccaggctccgaggtaggggctagggaatggtatttcatacattacgcagtagtggtgacgaccatatactacgcagactctgtagaacgggccgtattcatcatcctcagagacaagtggacaaacactcactagtatcgtaagtaaactacgaaacacgaccgtaggaacgtaacggtaccggaaggaccgtaacgggtacttaggttaaattacgtttaagttcggtagacgtaacggacccgtacccccggtaaggttcgaacccggg

SEQ ID NO: 441747 - DNA, 678 bp, Homo sapiens
  misc_feature: GZ8MTXP02IFE8L.11.57.F02.1.454.CMB.2.raw
  modified_base (205)..(205): a, c, t, g, unknown or other
  modified_base (266)..(266): a, c, t, g, unknown or other
  modified_base (272)..(272): a, c, t, g, unknown or other
  modified_base (286)..(286): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtggggaaaacngtccaccctctcctgcagggccagtacaaaaatattaaacaactacttagcctggtacaanagaacngcagctccagctcnatctatgatgactagtttaggacgggccaagtggaccactcccccaaccgtagggtttccaaggtcggactagggttgggtcgtggggaacctaggtaaccttctaatttccaccacccaacgtcccgacgaccgtaccgttaaggaccgtaccgttaagaaaacgtttagtttttacgaccgtttaaaggttttaactttacgttaggtaaccaaaacgacgtaccgtaagacgaacgacgacggtcccgttcccgggacggtaccggttacggaccggaaacgggaaacggaacggtaagggaacgtaacggaaagaccgaaaggttggtacgacgtacgaccaacctagtcgttcgttacttacctacttacctccccgtactactacg

SEQ ID NO: 441748 - DNA, 542 bp, Homo sapiens
  misc_feature: GZ8MTXP02FQADV.11.57.F02.1.454.CMB.2.raw
  modified_base (365)..(365): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggtccaacagaacctgccaggctccagctcctcatctatgatgcatttaggagggccactggcactcccaccaggttcagtggcaggtggtctgggacagacttcattctcnccatccgtnacgcctagacgcctagaagtattttgactagtttattactgtacaacagtacgtagcagcgaggcctccggcgacgttccggaccgaaggggaccgaaggtggaaacgtcaagtacgaacgtgtacggctcgcgacagtctaagtctctactccttcccgactactcg

SEQ ID NO: 441749 - DNA, 765 bp, Homo sapiens
  misc_feature: GZ8MTXP02H8IVM.11.57.F02.1.454.CMB.2.raw
  modified_base (205)..(205): a, c, t, g, unknown or other
  modified_base (261)..(261): a, c, t, g, unknown or other
  modified_base (271)..(271): a, c, t, g, unknown or other
  modified_base (279)..(279): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtaggggaaacngtcaccctctctgcgagggcagtacaaatattaacaactacttagctgtacaacanaactgcagcnccagctcnatcatgatgactagttaggacggcacgtcggacactccccaccgtaggttcgaggtggacgtgggtagggtcgtacggggactacggtacttactatttaccacctaccgtacctcccggaccgacgtacctaaggaccgtacctaaggttaaacgttagtttttacggacgttttaaggtttaacttttaacgttacgtaaacgtaaacgtacggtacgttaacgaccgtagggacccgtaccggggtaccccgtaccggggtaccggttaaccgggggttaccgggaaacccggaaacgggggtaaacccggtaaagggggtaaaccggggtaaacggttaaaccggaaacgggttaacggtaaaaccgggttgggggtacgtaccgttacggaacctaacccgtttagttaaccgtttaaccggtttacccgttaaccgtaccctttacccgtttacccccggtaactttaaccgtttaccgg

SEQ ID NO: 441750 - DNA, 572 bp, Homo sapiens
  misc_feature: GZ8MTXP02H15SP.11.57.F02.1.454.CMB.2.raw
  modified_base (279)..(279): a, c, t, g, unknown or other
  modified_base (362)..(362): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaatattaacaactacttagctgtcaacagaaactgcagctccagctcncatctatgatgctatttaggagggccactggcactcccacccaggttcagtggcagtgggtctgggacagtacttcattctcnccatccgcacgcctagacgcctagagattttgctagtttattacttgtacaacgtagcgtagcgagcacgggtcccgtccgggcgtaccggtttccgggaccgtaaacggggaccgaaaggggttgggaaacgtacgaaacggacgaaacgtggtacggcgtcggccacctattcgtcgttacttctacttccttaccccgcctactccg

SEQ ID NO: 441751 - DNA, 709 bp, Homo sapiens
  misc_feature: GZ8MTXP02H0QKF.11.57.F02.1.454.CMB.2.raw
  modified_base (376)..(376): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggtttcttgttgctatttagaggtgtccagtgcgaggtgcaagtggtgcagtcgtgggggaggcttagtccgaggccggggggtccctgagactctcctgtctagtctctggattcgccttcagtgactatgcatgaagtcggtccgcaggctccgagggtaaggggctagggagttggatttcgaatactattcgctagtaggtggggtgaccggaacctnttaatacgtaaccggtcaaaggtacctacgttcgggttaggaaacgggggtcccgggtaaactttcgaacttccgtaaacttccctacccgaagggaaacgaaacctaaacgttagggtacccgtaaaaccaaacccgttacctaaacccggttattaaacgttaaccgtagggtaaaacttaacccgaaaacgtaaccgccgttacgtaaaagggacggtaccggaaacggggaaccacggggtaccttaacggttactttaaaggtttatttaaggtcggtacggaccggttaccggtacccccccggttaagggttccggtaacccgggg

SEQ ID NO: 441752 - DNA, 565 bp, Homo sapiens
  misc_feature: GZ8MTXP02IPZ2I.11.57.F02.1.454.CMB.2.raw
  modified_base (305)..(305): a, c, t, g, unknown or other
  modified_base (366)..(366): a, c, t, g, unknown or other
  modified_base (368)..(368): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctgcaggctccagctcctcatcatgatgcatttaggnggccactggcatccccaccagttcagtggcagtgggtctcggggacagtacttcatttccncncctatcccgcagtccctagacgtcctagaagtattttgctagttttattacttcgtacaactagtacgtagctagcgacggcctccgggccgtacgttccggaccgaaggtaccgaaggtcggaaagtcgaagtacggaacgtgtcgacgtcgaccgtacctatcgtgttaccttctacttccttcccgctacttcg

SEQ ID NO: 441753 - DNA, 563 bp, Homo sapiens
  misc_feature: GZ8MTXP02IT0OE.11.57.F02.1.454.CMB.2.raw
  modified_base (353)..(353): a, c, t, g, unknown or other
  modified_base (363)..(363): a, c, t, g, unknown or other
  modified_base (370)..(370): a, c, t, g, unknown or other
  modified_base (426)..(426): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccagggccggggggtccctgagactctcctgtctagtctctggattcgccttcagtgactatgccatgaagtcggtccgcaggcctaccgaggtaaggggctaggatggatttcatacattacgnagtagtggtnaccgacntatactacgcagactctgtagaagggcccgattcgatcattcctaccagagacaangaccaaacaactcacttgtatcgtagaaactacgaacacgacctagaggtaagtcggaaggacccgaaggtacgtagtaaacttagtttaagttggtgtacggacgaaccggtccccccgtaaggtcgtaaccccgg

SEQ ID NO: 441754 - DNA, 661 bp, Homo sapiens
  misc_feature: GZ8MTXP02IVL37.11.57.F02.1.454.CMB.2.raw
  modified_base (382)..(382): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctggggagggcttttgttggagaccttgcacttgtactccttgccattcagccagtcctggtgcaggacggtgaggacgctgaccacacggtacgtgctgttgtactgcctcctccgcggtctttgtcttggctattatgccaccctccacgccgtccacgtaccagttgaacttgaccctcgtaggggttccttcgtcggcctaccaccgtccccaacccaccaaccgctaatcgtacgaccctcggacggggtcccnccgaaggcctaccccgaaggggtaacggggctaggggaaattggtaactttccaattaaactattaacgctaagggttacggtagggtgaccgaacctaattaactaacgtacgacaggacttcgtaggtacgaacgggtacctaattcacttcaacttccaccgaagacgaacaagtacggactaaactaactcctacgttataacgtacttaaaggaaacttaccaaacgacgtacctaaggagtaacggtacggaggaacctacgggtactttaag

SEQ ID NO: 441755 - DNA, 631 bp, Homo sapiens
  misc_feature: GZ8MTXP02FOOM6.11.57.F02.1.454.CMB.2.raw
  modified_base (263)..(263): a, c, t, g, unknown or other
  modified_base (313)..(313): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaacaactacttagcctggttccaanagaaacctggccaggcctccaggctcctcatctatgatgctagtttaggngggccacgtggcactccccacctagggttcaggttggcagggtcggggtcgtgggacacgtacttcatttcctacaccgatcccgacacgtccctaagacggtccctagaagttagttttgacttaggttttaacttactgtacaacgtagtcgtagacacgtccgacggcccgtccgggaccgtaccggttaccggaccgtaaacggggaccgtaagggtaggaaacgtagaaacggtacggtaaacgtcggtcgggaccttggaccctaccgagttcctcgttaccgttcacttccgtttaccccgcctacttccg

SEQ ID NO: 441756 - DNA, 545 bp, Homo sapiens
  misc_feature: GZ8MTXP02IRCGX.11.57.F02.1.454.CMB.2.raw
  modified_base (300)..(300): a, c, t, g, unknown or other
  modified_base (352)..(352): a, c, t, g, unknown or other
  modified_base (409)..(409): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggtttcctgttgctattttagaaggtgtccagtgcgaggtgcaagtggtgcagtctgggggagcttagtccagccggggggtccctgagactctcctgtctagtctctggattcgccttcagtgactatgccatgaagtggtccnccaggctccaggtaaggggctgaatggatttcatacattagcagtagtggtngaccatatactacgcagactctgtgaagggccattcattcatctccgagagacaaanagacaaacaactactactagtatacgtagaaataacaaacacgaccgtacgaagacggtacggaacggaacgaacggacgtacgttaattaattaagttaagtcgacgacgaccgtaccccgtaccggtacgtacg

SEQ ID NO: 441757 - DNA, 687 bp, Homo sapiens
  misc_feature: GZ8MTXP02GCZBH.11.57.F02.1.454.CMB.2.raw
  modified_base (263)..(263): a, c, t, g, unknown or other
  modified_base (312)..(312): a, c, t, g, unknown or other
  modified_base (333)..(333): a, c, t, g, unknown or other
  modified_base (379)..(379): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaanagaaacctggccaggctccaggctcctcatctatgatgctagtttaggnggccagtggcactccccaccnggttcaggtgcaggtgggtctcggggaacagtacttacgtattccncaccatccggacaacgcccttaaggacgacccgttagaaagttacgtttttacgacttaaagtttttaactttaacgtagtttaaccaaaacgtacggacgttaacggaaccgaaggaccgacgggtacccgttacccgggaccggtaccggttacccggaccggaacggggaaacgtaacgggtagggaaacgtacgaaacggacggtaaaccgttagggtacggtacgtacggacctaaaccgtacgttaccgttaacgtttaccgttacctaacgtttcccgttaccccgtaccgtactttaccg

SEQ ID NO: 441758 - DNA, 532 bp, Homo sapiens
  misc_feature: GZ8MTXP02F5LO1.11.57.F02.1.454.CMB.2.raw
  modified_base (454)..(454): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccgggggggtccctgagactctcctgtctagtctctggattcgccttcagtgactatgccatgagtggtccgcaggctccgaggtagggctggatggtatttcatactattagcagtagtggtgcgacatatactacgcagactctgtagaacgggccgtatcatcatctccagacaacaatacggacaaacaacctcacttgtaatctaggaaatcaaacngacctagaagacgtcggaaacgacacggctagtatatttagtgtagcgaacggaccgtcccccgtacggtcgacccgg

SEQ ID NO: 441759 - DNA, 511 bp, Homo sapiens
  misc_feature: GZ8MTXP02I76B4.11.57.F02.1.454.CMB.2.raw
  modified_base (363)..(363): a, c, t, g, unknown or other
  modified_base (412)..(412): a, c, t, g, unknown or other
  modified_base (480)..(480): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtccctgagactctcctgtctagtctctggattcgccttcagtgactatgccatgaagtgggtccgccaggctccgaggtaaggggctggatggatttcatacattgcagtagtggtgcgacntatactacgcagactctgtagaaggggccattcgatcatcctaccaganacatggacaaacactcactgtactctaggaatcaacagcctagagacgtacgaggacaggtctgtatnttatgtgacgacgacgccccgtagtcgtacg

SEQ ID NO: 441760 - DNA, 610 bp, Homo sapiens
  misc_feature: GZ8MTXP02HFZGD.11.57.F02.1.454.CMB.2.raw
  modified_base (259)..(259): a, c, t, g, unknown or other
  modified_base (280)..(280): a, c, t, g, unknown or other
  modified_base (357)..(357): a, c, t, g, unknown or other
  modified_base (364)..(364): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaatattaacaactactagcctggtcaanagaactgcaggctccagctcncatctatgatgctatttaggagggccatggcactccccacctaggttcagtggcaggtgggtctggggacagacttnattctcncactccgcacgccctaggacgccctagaacgttagtttgacttagttttacttactgtacaactaggcgtaagacagtcgacggtccgtacccgggacgtaccggttaccggaccgaaagggggacccaaaggggtcggaaacggtacaaaacggtacggaaacgttgggttacgggacttcgggacctaaccctaagttcgtaacgttccttacgtaccttcgtttacccccgacgtactttccg

SEQ ID NO: 441761 - DNA, 633 bp, Homo sapiens
  misc_feature: GZ8MTXP02H8GTI.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggcccggggggtcctgagctctcctgtctagtctctggattcgccttcagtgactatgccatgaagtcgggtccgccgaggcctccgagggtaagggctagggaatggtattcatactattacgctagtacgtggtgacgacatatacacgcagactcgtgtagacggcctattcatactacgtcctaccgaagaacgtacaagtacggaccaaaaccgtaaacttacctaacgttagtaacttaccgtaacggtaaaacttaccgaaaacgtacgtaccgtaaggaacggtaacggtaccggaacgggaaaccgtacgggtacgttacggtaatttaactttagttaaggttacggacgtaacggtaacccggtacccccgttaagggtaccgtacccggg

SEQ ID NO: 441762 - DNA, 615 bp, Homo sapiens
  misc_feature: GZ8MTXP02GEJMJ.11.57.F02.1.454.CMB.2.raw
  modified_base (203)..(203): a, c, t, g, unknown or other
  modified_base (262)..(262): a, c, t, g, unknown or other
  modified_base (290)..(290): a, c, t, g, unknown or other
  modified_base (411)..(411): a, c, t, g, unknown or other
  modified_base (423)..(423): a, c, t, g, unknown or other
  modified_base (459)..(459): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttaccaanagaaacctgccaggctcccaggctcctnatctatgatgctagtttagggacgggccacgtggacacgtacccccaaccgagggtttccaaggttcggctacgggtggggtctcggggaacagtaacttcatttccacacccatcccggnacgcctaagacncctagaagtactttgactagtttatactgtacaaangacgtagacaagcacggggtcctccgggacggtaccgttacgggacccaaaggggacccgaaagggtaggaaagtcgaaaggtacgaaacgttggcgggtacctacgacctacgtacttacgtcgttaccttacacgttccgtacccgactacgtc

SEQ ID NO: 441763 - DNA, 635 bp, Homo sapiens
  misc_feature: GZ8MTXP02JTQXN.11.57.F02.1.454.CMB.2.raw
  modified_base (258)..(258): a, c, t, g, unknown or other
  modified_base (264)..(264): a, c, t, g, unknown or other
  modified_base (270)..(270): a, c, t, g, unknown or other
  modified_base (273)..(273): a, c, t, g, unknown or other
  modified_base (278)..(278): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaatataacaactactagctgtcaanagaacngcagcnccngctcnatctatgatgactagtttaggagggccagtggacactccccaccgagggttcaggtcggcgtaggtgggtcgtcggggacagtacttcacttccacacctacgtccgactacgccctaaggacgtaccctagaaagttattttgacttaagttttaattacgttacgtacaaacgtagtacgtacgacgagaccgacgggtcccgtaccgggacggtaccggttccggaaccgtaaacggggaaccgtaagggtacggaaacgtacgaaacggacgtaaacgtggtacggactacggaccaacctacgtccgttcgttaccttaccgtacttcccgttaccccgactaacgtttccg

SEQ ID NO: 441764 - DNA, 616 bp, Homo sapiens
  misc_feature: GZ8MTXP02HF1CS.11.57.F02.1.454.CMB.2.raw
  modified_base (374)..(374): a, c, t, g, unknown or other
  modified_base (376)..(376): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgctagtttaggagggccagtggcatccccaccagggttcagtggcaggtgggtctggggacagtacttcattcncncctatccgcagcctagacgccctagaacgtattttgacgttagttttaattactagtactaaactaaggtaccgttagaccgaacgcgtaacgggtcccgtcccgggaccggtaccggttccggacccggaaacggggaacccgtaaggggtaggaaacggtacgaaaacggcggtaaaacgtggtacgggctacggaccaccgattcctggtcttacactttccgtcccgtcctatccg

SEQ ID NO: 441765 - DNA, 537 bp, Homo sapiens
  misc_feature: GZ8MTXP02HU4NS.11.57.F02.1.454.CMB.2.raw
  modified_base (383)..(383): a, c, t, g, unknown or other
  modified_base (460)..(460): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggattcaccatggagttggggctgtgctgggttttccttgttgctatttagaggtgtccagtgcgaggtgcaagtggtgcagtcgtgggggaggcttagtccaggccggggggtccctgagctctcctgtctagtctctggattcgccttcagtgactatgccatgaagtgggtccgcaggctccgagggtaaggggctgggaatggatttcatactattagctagtagtggtgcgacatataactacgcagtactntggtagaacgggccattcatcatcctaccagacgacaagtcgacaaacactacactgtactcgtagaaatacaaacncgctagagtacgtacgaggacacggctgtaactagtttatggtacgcgtacgaccggtacccccgtaggtcgaccgg

SEQ ID NO: 441766 - DNA, 518 bp, Homo sapiens
  misc_feature: GZ8MTXP02HAKLQ.11.57.F02.1.454.CMB.2.raw
  modified_base (261)..(261): a, c, t, g, unknown or other
  modified_base (288)..(288): a, c, t, g, unknown or other
  modified_base (347)..(347): a, c, t, g, unknown or other
  modified_base (365)..(365): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaanagaaacctggccaggctccaggctctnatctatgatgcatttaggagggccactggcatcccaccaggttcagtggcagtgggtcnggggacagacttcattcncaccatccgcagcctagagcctagaagatttgctagtttattactgtcaacagcgtagcagcagggctccggcgacgttcgaccaagggaccgaagtggaagtcaagcggaaactggcgctcgacacatcgtgtctctactctcctcctactc

SEQ ID NO: 441767 - DNA, 725 bp, Homo sapiens
  misc_feature: GZ8MTXP02IC88H.11.57.F02.1.454.CMB.2.raw
  modified_base (373)..(373): a, c, t, g, unknown or other
  modified_base (437)..(437): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctccagataccaccggagaaattgtgttgacacagtctccggccaccctgtctgcgtctccgtggggaaacagtccaccctctcctgcacgggccaagtacaaaattattaaacaacttacttagccttaggttaccaacagaaacctggaccaggcctccaggctcctcatctatgatgactagtttaggagggccacgtggcactccccgaccaggttcaggtggactaggtgggtcgnggggactagtacttactattcctcaccacttccggcaagtcccctagacgtccctagtaacgtnttttacggacttaagttttactttacgttcggtactaaacgtaacgggtcgtaagggaccctaggaccgtaacgggtacccgtttccccggggaccgggttaacccgggtttcccgggaacccggtaaaacgggggaacccgtaaacgggggttagggaaacgttaaccgaaaacggaccggtaaaaccggttgggttacgggtaacccgtacggaccctaaccgtacgttaccgttaacgttaccgttacctacccgttccccgtttaccccgtacctttacgtccg

SEQ ID NO: 441768 - DNA, 666 bp, Homo sapiens
  misc_feature: GZ8MTXP02IJW2D.11.57.F02.1.454.CMB.2.raw
  modified_base (203)..(203): a, c, t, g, unknown or other
  modified_base (394)..(394): a, c, t, g, unknown or other
  modified_base (401)..(401): a, c, t, g, unknown or other
  modified_base (429)..(429): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctgctccagataccaccggagaaattgtgttgacacagtctccggccaccctgtctgcgtctccgtaggggaaacngtccaccctctcctgcgagggccagtacaaaatattaaacaacttactagcctagttaccaacagaacctggcaggcctccagcctcctacatctatgatgactagtttaggacgggccactggccactccccgacccgtaggttcaggtgcgtaggtcgggtcgtacggggacagtacttctactttccncaccgtntccgcacgtcctagacgtctagtaaatntttagcttaagttttacttacgtagtacaaacgtgtacgtagccaagtcgacggtcccgtacgggacggtaaccggttccgggaaccgtaaacggggaacccgtaaggggttaaacggaacgtaacggaaacggaccggtaaaacggttggaacggtccgaggtaccccgacctaagttccgtttaacggttaacctttcctaccgtttccccgttacccccgactttaaccgttcg

SEQ ID NO: 441769 - DNA, 534 bp, Homo sapiens
  misc_feature: GZ8MTXP02IUS0F.11.57.F02.1.454.CMB.2.raw
  modified_base (373)..(373): a, c, t, g, unknown or other
  modified_base (417)..(417): a, c, t, g, unknown or other
  modified_base (455)..(455): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggccggggggtcctgagactctcctgtctagtctctggattccgccttcagtgactatgccatgaagtcgggtccgccgaggcctccgagggtaaggggctagggaatggatttcatacattagcagtagtggtgcgaacntactactacgcagactctgtagaaggccattcatcatctcaganacaatgacaaacactcactgtatactagaaatcaaacngacctagaagacgtacggagaccaggtctagtattagttagttcgtgacgtacgaccgtcccccgtaggtacgtaccgg

SEQ ID NO: 441770 - DNA, 558 bp, Homo sapiens
  misc_feature: GZ8MTXP02F9P8Y.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctcccaggctcctcatctatgatgcagtttaggagggccagtggcactcccaccaggttcagtgcagtggtctggacagacttcattctcaccatccgacacgcctagacgcctagaagtatttgactagtttattactgtactaacagacgtagacagcaacggccgtccggacggtacgttcggaccgaaacgggaccgaaagggtgaaacgtacaaacggacgacgtaggtcggcgtcggaccacactctaagtcttctactccttccgcctatcg

SEQ ID NO: 441771 - DNA, 579 bp, Homo sapiens
  misc_feature: GZ8MTXP02G9WFV.11.57.F02.1.454.CMB.2.raw
  modified_base (354)..(354): a, c, t, g, unknown or other
  modified_base (407)..(407): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacagtcaccctctcctgcagggccagtacaaaatattaaacaactacttagcctggtaccaacagaactggcagctccagctcctcatctatgatgactagtttaggagggccagtggcactccccaccgaggttcagtcggctaggtgggtcnggggacagacttcattcctcaccatccgacacgcctagacgccctagaaagtntttttaggacttaagtttaatttacgtagtactaaacgagacgtagccagcacggtccgtcgggcgtacgttcggaccgaaacgggaccgaaagggtacgaagtacgaaagcgaaacgtggtacggctacggaccaccgtatcgtaacgtcttacacgtcctcccactactc

SEQ ID NO: 441772 - DNA, 529 bp, Homo sapiens
  misc_feature: GZ8MTXP02H6MH3.11.57.F02.1.454.CMB.2.raw
  modified_base (452)..(452): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttcagtgactatgccatgaagtcgggtccgccaggcctccgaggtaaggggctaggaatggatttcatacatagcagtagtggtgcgacatactactacgcagactctgtgaagggccattcatcatcctacagacgacaatggacaaacactcactgtactcgtagaaatcaaacncgacctgacgtagtcgaggacacggtctagtattattagtgtcgacgtacgaccgacccccgtagggtacgtaccgg

SEQ ID NO: 441773 - DNA, 625 bp, Homo sapiens
  misc_feature: GZ8MTXP02JQP10.11.57.F02.1.454.CMB.2.raw
  modified_base (373)..(373): a, c, t, g, unknown or other
  modified_base (430)..(430): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccgaccaccctgtctgcgtctcctggggaaacagtcaccctctcctgcagggccagtcaaaatattaaacaactacttagcctggttccaacagaaacctgccaggctccaggctcctcatctatgatgctatttaggagggccacgtggcactccccaccaggttcagtggcagtgggtctggggacagtacttcattccnctccatccgcagcctagcgcctagaacgtatttgcttagtttattactgtacaaacngtacgtacgactaggcacgggcccgtccgggacggtaccgttacgggaccgaaacggggaacccgaaggggttaggaaacgtacgaaaacggaccggtaaaacttgggtacggcttacggaccgtaaccaacgtttccgtaaggttaccctttacgaacctttccccgtttcccccggaccctaacgtttcccgg

SEQ ID NO: 441774 - DNA, 610 bp, Homo sapiens
  misc_feature: GZ8MTXP02IT98L.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcaggccagtcaaaatattaacaactacttagcctggttaccaacagaaacctggccaggctcccaggctcctcatcatgatgcatttaggagggtccactggcactccccaccaggttcagtggcaggtggtctgggacagtcttcattcctcacctatccgcagtccctagacgcctgaaacgtattttgacttagtttattacttagtacaaacgtagcgtagcagcacggccgtcgggacgtacggtccggaccgaagggacccgaagggttaggaaacgtacgaacggtaccggaaacgtggtacgggtacgtacggacctaaccgtaacttcggttaacggtttccgttacgtaaccttcccgttaccccggtacctactttaccgg

SEQ ID NO: 441775 - DNA, 631 bp, Homo sapiens
  misc_feature: GZ8MTXP02G281R.11.57.F02.1.454.CMB.2.raw
  modified_base (405)..(405): a, c, t, g, unknown or other
  modified_base (427)..(427): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttaccaacagaaacctggacccaggcctacccaggctcctcactctatgatgactagtttagggacgggccacgtcggcacgtccccaacccgtagggttccaagggtcggcctaggtcggggtctcggggactagtacgttcattccncaccatccgcacgcctaggacncctagaagttactttgacttagtttattactcgtactaacgagtcgtaagtcagcgacggtcctccgggacgtacgttcacgaccgaacgggaccaagggtgaaagtacgaaaggccgtaaagtcggtacggacttcgggaccctaaccgtagttccgtacggttccgtttactaacgtttccccgttaccccgtaccgtaacg

SEQ ID NO: 441776 - DNA, 673 bp, Homo sapiens
  misc_feature: GZ8MTXP02I6MKY.11.57.F02.1.454.CMB.2.raw
  modified_base (384)..(384): a, c, t, g, unknown or other
  modified_base (415)..(415): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaaacaactacttagcctggtaccaacagaaacctgccaggctcccaggctcctcatctatgatgcagtttaggagggccagtggcactccccacccaggttcagttggctaggtgggtctcggggacaggtacttctattcctacncctactccgcacgtcctagcgcctagaagtntttgactagttttattactgtactaacgagacgtagacgacggtacgaccgggtcccgtccccggggtacgtaacccggggtttccgggaacccggaaacgggggaacccgtaaaggggttacggggaaacgtacgaaacggacgtaaaacgttcgggtacggggtaccgttacggacccaaccgtaacgtttccgttaacggttcccttttaaccggtacctttcccgtttacccccggacctttacgtttacccgg

SEQ ID NO: 441777 - DNA, 657 bp, Homo sapiens
  misc_feature: GZ8MTXP02H22GO.11.57.F02.1.454.CMB.2.raw
  modified_base (288)..(288): a, c, t, g, unknown or other
  modified_base (351)..(351): a, c, t, g, unknown or other
tcagcgagagataccacgaccggtgctcgatttagctcgatatagttgggtttggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgcttgttgtactgcctcctccgcgtctttgtcttggctattatgcacctccacgccgtccacgtaccagttnacttgacctcgaggtctcgtgctcacgtccaccaccacgcagtgtcgacctcgacggggtccncgacggctcccgaaggggtacggggctaggaagtggactttcattacatttagctagtagtggtacgacgaacctaagttactaactaccgactaacggtacttcgtaggtacggaaacggggtcccgtaaatttcgagtttaccaactccgtaccgaaagtaaccgaaccgtaaagtccggaacctaaaaccgtaaccgtacctaaacgttaggttaactacggtaaacggaaaacttaccaaaccggacgtacccgttaaggaaaccggtagtacccgggaagtacccgaaacgggttcttaag

SEQ ID NO: 441778 - DNA, 592 bp, Homo sapiens
  misc_feature: GZ8MTXP02IHG07.11.57.F02.1.454.CMB.2.raw
  modified_base (279)..(279): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggttttccttgttgctattttagaagtgtccagtgcgaggtgcaagtggtgcagtcgtgggggaggcttagtccaggccggggggtccctgacgactctcctgtctagtctctggattcgccttnagtgactatgccatgaaggtcgggtccgccaggctccgagggtaaggggctgggaatggtatttcatacattagctagtagtggtagccgacatatactaccgacagctctggtagaagggccgtattcatacactcctaccaagacgaacaagtacggaacccaaacaaacttaccacgttagtaactacgtaaggtaaaactacaaacgtacgacccgtaggaacgtaggtacggaaggacaccggacttacgttaattattaagtgtacgtacggacgtaacccgtcccccgttacgggtacgtaccggg

SEQ ID NO: 441779 - DNA, 564 bp, Homo sapiens
  misc_feature: GZ8MTXP02HZKTD.11.57.F02.1.454.CMB.2.raw
  modified_base (305)..(305): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgcttattttagaaggtgtccagtgcgaggtgcaagtggtgcagtcgtgggggaggcttagtccgaggccggggggtccctgagactctcctgtctagtctctggattcgccttcagtgactatgccatgagtggccncaggctccgaggtaagggctggatggatttcatacattagctagtagtggtgcgaccatatactacgcagactcgtgtagaaggccgtattcatcatcctaccagaacacaatggacaaacactcaacttgtactacgaggaaactcaaaacgcgaccgtagaacgtaggtaccggaagggacctacgggtacttggtaaaacttatttacgtggtacgtacggacggacccgtacccccgttagggtacgaacccggg

SEQ ID NO: 441780 - DNA, 582 bp, Homo sapiens
  misc_feature: GZ8MTXP02GCAFV.11.57.F02.1.454.CMB.2.raw
  modified_base (355)..(355): a, c, t, g, unknown or other
  modified_base (536)..(536): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccgcggctttgtcttggcattatgcacctccacgcccgtccacgtaccagttgaacttcgacctcgaggtctcgtggctcacgtcccaccaccacgcatgtcgacctcggacggggtcccnccgaggtcctaccccgaaggggtaacggggctagggaactggtactttcgatacagttagctaaggtagtggtgacgacatatactacgacagactcgtgtaggaacgggcctattcatcactctaccaagagaacaagtcggacaaacactacacttgtatacgtagaaaactcaaaacncgacctaaggaacgacgtacggacggaacgtaccgggactttaagg

SEQ ID NO: 441781 - DNA, 610 bp, Homo sapiens
  misc_feature: GZ8MTXP02IQJ2O.11.57.F02.1.454.CMB.2.raw
  modified_base (262)..(262): a, c, t, g, unknown or other
  modified_base (381)..(381): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaanagaaacctggcaggctccagctcctcatctatgatgcatttaggagggtccacgtggccatccccaccaggttcaggttgcagtcgggtctgggacagtacttcattctcacatcccgnacgccgtagacgcctagaagtgtttgctagtttattacgttgttacaactagacgtagacgacgtacgacggtccttacccgggacgtaccggttaccggaccgtaaacggggacccgaaaggggttcggaaacgttacgaaacggtacgaaacgttaggtcggggtactcggccaaacctgttacgttcggttccttacttactccgtttcccgacctacgtttaccg

SEQ ID NO: 441782 - DNA, 658 bp, Homo sapiens
  misc_feature: GZ8MTXP02GS8HD.11.57.F02.1.454.CMB.2.raw
  modified_base (204)..(204): a, c, t, g, unknown or other
  modified_base (327)..(327): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccaccctctcctgcagggccagtacaaatataacaactactagctgtcaacagaactgcaggctccagctctcatctatgatgctagtttaggacgggcactggcactcccacctaggtcngtgctaggtcgggtctggggacagtaccttcgacttccctacaccctataccccgcgaacgtcccgtaaggacgaccccttagaaacgtttacgttttgggacctttaaggttttaacttactacggttaacaaacgagtacgtagacgacgacgacggtccgtccgggaccggtaccgttacccggaccgaaacggggaaccgtaaggggtacggaacgtacgaaacggtacgaaacgtacgggtcggtactacggaccgtaaacctacgttccgtaacgtttccctttacgacccgtttccccttaccccggtacctactttaacccgg

SEQ ID NO: 441783 - DNA, 524 bp, Homo sapiens
  misc_feature: GZ8MTXP02J0Y7G.11.57.F02.1.454.CMB.2.raw
  modified_base (483)..(483): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcaggtcgtgggggaggcttaggtccgaggcccgggggggtccctgagactctcctgtctagtctctggattcgccttcagtgactatgccatgagtggtccgcaggctccgaggtaaggggctaggaatggatttcatacattagcagtagtggtgcgacatatactagcagactctgtagaagggccgtattcatcatctaccagacgacaagtcggacaacaactcactagtatcaggaaactcaaacagcctagacgtaggcgaggacacggntagtatattatgtcgacgacgaccgccccgtaggtcaccgg

SEQ ID NO: 441784 - DNA, 599 bp, Homo sapiens
  misc_feature: GZ8MTXP02HLZ7J.11.57.F02.1.454.CMB.2.raw
  modified_base (378)..(378): a, c, t, g, unknown or other
  modified_base (380)..(380): a, c, t, g, unknown or other
  modified_base (387)..(387): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctcccaggctcctcatctatgatgctagtttaggagggccacgtggcactccccacctaggttcagtggcaggtgggtctcgggacagtacttcattcncnccatccncagcctagacgcctagtaacgtattttcgacttagttttattactagtacaaacgagacgtagcgagcgacggtcccgtccgggcgtaccggttcggaccgtaacgggaccgaagggtaggaacgtacgaacggtacgaaacgtggtacggcgtcggaccacctagttccgttcggtccttactacgttcccgttccccgacttaacttccg

SEQ ID NO: 441785 - DNA, 565 bp, Homo sapiens
  misc_feature: GZ8MTXP02GZIOY.11.57.F02.1.454.CMB.2.raw
  modified_base (279)..(279): a, c, t, g, unknown or other
  modified_base (374)..(374): a, c, t, g, unknown or other
  modified_base (487)..(487): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccaatgcgaggtgcaagtggtgcagtcgtgggggagcttagtccaggccggggggtccctgagactctcctgtctagtctctggattcgccttnagtgactatcgccatgaagtcgggtccgcaggcctaccgagggtaaggggctagggaatggtatttcatactattacgcagtaggtggtgcgacntactactacgcagtactcgtggtagaacggggtccctaagttcatcatcctaccaggtaacaacaagtacggacaaacctactcacttagtactacgtaagaactacgaaacngaccgtagaggtacgcggacgacgacggcttagtacttattacgtgtcgacgtacgaccgtcccctaggtctacccgg

SEQ ID NO: 441786 - DNA, 629 bp, Homo sapiens
  misc_feature: GZ8MTXP02JIYBE.11.57.F02.1.454.CMB.2.raw
  modified_base (259)..(259): a, c, t, g, unknown or other
  modified_base (285)..(285): a, c, t, g, unknown or other
  modified_base (484)..(484): a, c, t, g, unknown or other
  modified_base (597)..(597): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggtcaccctgtctgcgtctcctggggaaacagtcaccctctcctgcagggccagtcaaatataacaactacttagcctggtccaanagaacctggcaggctccaggctcctnatctatgatgactagttaggcggccagtggccactccccaaccgtaggttacaggtcgcgtaggtcgggtcgtacgggactagtaccttcgtactttcaccaccgtactcccgacaccgtaccgtaaggaccgtccgtaaaggtaacgtttacgtttttcgaccgtttaagtttttaacttaccgttgtaactaaacgnggtacgtagcgaacgcggacggtccccgtacgggaccgggtaccggttccggaaccggaacgggaccgtagggtacgaacgtacgaagacgtacgtggtcgactcgccacgtntcgtcgttactcgtactccgtaccgctattcg

SEQ ID NO: 441787 - DNA, 518 bp, Homo sapiens
  misc_feature: GZ8MTXP02JZT1X.11.57.F02.1.454.CMB.2.raw
  modified_base (430)..(430): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccgggggggtccctgagactctcctgtctagtctctggattcgccttcagtgactatgccatgaagtggtccgccaggctccgaggtaaggggctgggaatggatttcatacattacgcagtagtggtgcgacatactactacgcagactcgtgtgaagggccgattcatcatccaccagagacaagtgacaacactnactgtatctaggaaatacaacagcctagagacgtcggaggactacggctagtatattatgtgacgagaccgccccgtacggcgtaccg

SEQ ID NO: 441788 - DNA, 571 bp, Homo sapiens
  misc_feature: GZ8MTXP02IU8ZJ.11.57.F02.1.454.CMB.2.raw
  modified_base (262)..(262): a, c, t, g, unknown or other
  modified_base (288)..(288): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggccagtcaaaatattaacaactacttagcctggtccaanagaaacctggccaggcctccagctcncatctatgatgctagtttagggagggccacgtggccaactccccaacccgtaggttcagtggcaggtgggtctggggacagtacttcattcctacacctatcccgcacgtacctagacgtcctagtaagtattttgacttagtttattacgttgtacaacacgcgtagcagacgacggccgtccggcgtacggttccgaccgaagggaccgaagggtaggaagtacgaacgacgaacgtggcggctacgcactatctcgtctctactccgtccgtctacttcg

SEQ ID NO: 441789 - DNA, 559 bp, Homo sapiens
  misc_feature: GZ8MTXP02J3OYC.11.57.F02.1.454.CMB.2.raw
  modified_base (237)..(237): a, c, t, g, unknown or other
  modified_base (348)..(348): a, c, t, g, unknown or other
  modified_base (412)..(412): a, c, t, g, unknown or other
  modified_base (531)..(531): a, c, t, g, unknown or other
  modified_base (555)..(555): a, c, t, g, unknown or other
tcagcgagagataccacgaccggtgctcgatttagctcgatatagttgggtttggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtactgctgttgtactgcctcctccgnggtctttgtcttggctattatgccacctccacgccgtccacgtaccagttgaacttgacctcaggtctcgtgctcacgtccaccacacgcatgtgacctcgacggggtccnccgaggctaccccgagggtagggctaggatggtaatttcattaacattagcagttagtggtacncgaccatactactacgcagactcgtaggtacgaacgggcccgtaattcactcaatccgtaccaagacgaacaagtcgacaacaactcgactgtatacgtagaaactcaaacgtcgacgngagacgtacggagactaaccggtntacg

SEQ ID NO: 441790 - DNA, 546 bp, Homo sapiens
  misc_feature: GZ8MTXP02H2WY1.11.57.F02.1.454.CMB.2.raw
  modified_base (369)..(369): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaaggtggtgcagtctgggggaggcttagtccgaggccggggggtccctgagactctcctgtctagtctctggattcgccttcagtgactatgccatgagtgggtccgcaggctccgaggtaaggggctagggaatggatttcatacattacgctagtagtggtgcgaccntatactacgcagtactctgtagacggccgattcatcacttctccagacacaagtggacaaacaactcactgtatcgtaggaaatcgaaacacgcctaggacgacgtacggacggacgacggcttagtacttagttagttgtcgtacggacgtaccgtcccccgtaaggtcgaccggg

SEQ ID NO: 441791 - DNA, 535 bp, Homo sapiens
  misc_feature: GZ8MTXP02IKJTN.11.57.F02.1.454.CMB.2.raw
  modified_base (278)..(278): a, c, t, g, unknown or other
  modified_base (417)..(417): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggttttccttgttgctattttagaaggtgtccagtgcgaggtgcaagtggtgcagtcgtgggggagcttagtccaggccggggggtccctgagactctcctgtctagtctctggattcgccttnagtgactatgccatgaagtggtccgccaggctccgaggtaagggctaggaatggatttcatacattacgacgagtagtggtggaccgaacatatactaccgacagtactctgtagaggccgtatcatcatacctcaganacaatggacaacaactacactagtactcgtaggaaactacaaacagacctagagtacgtacgaggacacgactagtattattagttgtcgacgacgacgtccccgtacggtcgtacgg

SEQ ID NO: 441792 - DNA, 720 bp, Homo sapiens
  misc_feature: GZ8MTXP02JHARP.11.57.F02.1.454.CMB.2.raw
  modified_base (263)..(263): a, c, t, g, unknown or other
  modified_base (288)..(288): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttaccaanagaaacctgcaggctcccagctctnatctatgatgcagtttaggagggcccagtcggactactcccctaacccgaggttcaggtcggcgtaggtcggggttctacggggaacctaggtacttactattaccttcacccgtacttcccggacgtaaccgcccttaacggacgtccccttaaggtaaagttacgtttttacggacttaggttttaactttactcggtactaaccgtaagtacggtaagacgtaagccggaacggtcccccgtaccgggaccggtaacccgggtttcgggaaccccggaaaagggggtaccccgaaagggtagggttaaacgtaacgaaaaggtaacccggtaaaagtttcggaaacggggtccttaacggaccctaacccgtaagttccgttaacggtacttacctaacttccccttacccggtacccaagtttacccg

SEQ ID NO: 441793 - DNA, 574 bp, Homo sapiens
  misc_feature: GZ8MTXP02F0NSD.11.57.F02.1.454.CMB.2.raw
  modified_base (240)..(240): a, c, t, g, unknown or other
  modified_base (358)..(358): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgcctcctccgnggtctttgtcttggctattatgcacctccacgccgtcacgtaccagttgaacttgacctcgagggtccttcgtggctcacgtcccaccaccacgcatcgtcgacctcgacggggtccnccaggcctaccccgagggtaacggggctagggaatcggtatttcattacagttagctagtagtggtgcgaaccatactactacgacagactcgtgtagacgggcctatacatcatctaccgagagactaagtcgacaacactcactgtatcgtaagtaaactaccgaaacgtcgtacgtaagagtaacgtacgaacggactacgggtactttaagg

SEQ ID NO: 441794 - DNA, 804 bp, Homo sapiens
  misc_feature: GZ8MTXP02I69XL.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgctagtttaggagggccacgtggaccactccccaaccccgtagggttccaggttcggccgtaggtggggttaccgtggggacctaaggtactttcgtactttcctaccacccgtacttcccgaccgtacgccccttaaggacgtaccctaagtaaagttactttttgaccgttaaagtttttaacttacttcggtaacctaaacgtaaggtaccggttaagaccgtaagggacccgtaacggggcccccgttacccccgggggaccggtaaacccggggtttcccggggaaaccccgggaaaacgggggtaaccccggtaaaaagggggtttacgggggaaaaccgttaaacccgggaaaacgggtacccggtaaaacgggttccgggttaacggggtcccgttaacgggacccgtaaaccccgttaacgttccggtttaaccggttaccttttacccggtacctttacccccgtttcccccggacccctttagtttaccccgg

SEQ ID NO: 441795 - DNA, 589 bp, Homo sapiens
  misc_feature: GZ8MTXP02H02JW.11.57.F02.1.454.CMB.2.raw
  modified_base (205)..(205): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctcctggggaaacngtcaccctctcctgcagggccagtacaaaatattaaacaactacttagcctggttaccaacagaaacctggccaggctcccaggcctcctcatctatgatgctagtttaggagggccacgtggcactccccacccgtaggttcagtggcaggtggtctgggacagtcttcattctcacatccgcagtcctagacgcctagaatatttgacttagtttattacgtgtacaaacgagtcgtagtacaggccgacggtcccttacccgggacgtaccggttccggaccgaaacgggtaccgaaggtacggaagtacgaagacgaacgtggtcggactcgaccaaccattacgtgttcttacacttaccttcccgtcctaacgttccg

SEQ ID NO: 441796 - DNA, 624 bp, Homo sapiens
  misc_feature: GZ8MTXP02HK9JU.11.57.F02.1.454.CMB.2.raw
  modified_base (205)..(205): a, c, t, g, unknown or other
  modified_base (377)..(377): a, c, t, g, unknown or other
  modified_base (381)..(381): a, c, t, g, unknown or other
  modified_base (386)..(386): a, c, t, g, unknown or other
  modified_base (396)..(396): a, c, t, g, unknown or other
  modified_base (408)..(408): a, c, t, g, unknown or other
tcagcgagagataccacgaccggtgctcgatttagctcgatatagttgggtttgggggaggaactgctcagttaggacccagagggaaccatggaagccccagctaagcttctcttcctcctgctacactggctcccagataccaccggagaaattgtgttgacacagtctccggccaccctgtctgcgtctccgtggggaaacngtcaccctctcctgcagggccagtacaaaatattaaacaactacttagccttggttacccaaacagaaacctggaccaggctcccaggcctcctcatctatgatgcagtttaggacggccagtggcactccccaccgtgtcagtggcagtggtctgggacagacttcattcncacntccgnacgcctaagngcctagaacgtntttgacttagtttatttactagtacaactagtcctagcaagcgacggcccgttccggacgtaccgggttccggaccgaaggggaccgaagggtacggaaacggtacgaaaggaccgtaaacgtggttcggaccgtacggacctaccgtaacttccgtacggttcccgtttactaaccgtttccctacccccggtacctacgtttacccgttaacgg

SEQ ID NO: 441797 - DNA, 642 bp, Homo sapiens
  misc_feature: GZ8MTXP02FOCKU.11.57.F02.1.454.CMB.2.raw
  modified_base (204)..(204): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtcaaaatattaacaactacttagcctggttccaacagaaacctggccaggctccaggctcctcatctatgatgctatttaggagggccagtggaccactccccaccaggttcagtggcaggtggtctgggacagacttcattcctacnccactccgacacgccctagacgccctagaagtattttgacttagttttattaacgtgtactaacgagtacgttagacgacgcgaccgggtcctccgggaccgtaccggttacccgggaccgaaacggggtacccgtaaaggggtacgggaaacgttacgaaacggaccggtaaacgtcgggtacgggtccgtacggaccctaaaccgtactttccgtaaggtttcccgtttaccgacgtttccccctttccccggacctaactttccg

SEQ ID NO: 441798 - DNA, 565 bp, Homo sapiens
  misc_feature: GZ8MTXP02FTMK2.11.57.F02.1.454.CMB.2.raw
  modified_base (364)..(364): a, c, t, g, unknown or other
  modified_base (455)..(455): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggccggggggtccctgagctctcctgtctgtctctggattcgccttcagtgactatgccatgaagtggtccgccaggctcgaggtaagggctggatggtatttcatacattacgctagtagtggtgcgactntatactacgcagtactctgtagaacgggcctatcatcatcctacagagacagtgaccaacaactcactgtaactcgtaagaaactcaaacncgtacctagggaacgacggtccggaaggaaccgacgggtctttagtaacttatttaagttcggtagaccggtacgaccccggttacccccgtaagggttcgtaacccggg

SEQ ID NO: 441799 - DNA, 556 bp, Homo sapiens
  misc_feature: GZ8MTXP02J1GGX.11.57.F02.1.454.CMB.2.raw
  modified_base (204)..(204): a, c, t, g, unknown or other
  modified_base (361)..(361): a, c, t, g, unknown or other
  modified_base (363)..(363): a, c, t, g, unknown or other
  modified_base (381)..(381): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatataacaactacttagcctgttccaacagaacctgccaggctccaggctcctcatctatgatgcatttaggaggccagtggcatccccaccaggttcagtggcagtggtctgggacagacttcattcncnccatccgcagcctagacncctagaagtatttgacttagtttatactgtacaacgagtcgtagcagcacggcctcggacgtaagttccgaccgtaacgggaccgtagggtacggaagcgaagcggaaacgtggacggctacggaccaccgtattaccgtcgttcttacacttcccgttcccgacctacgttccg

SEQ ID NO: 441800 - DNA, 659 bp, Homo sapiens
  misc_feature: GZ8MTXP02JF9CB.11.57.F02.1.454.CMB.2.raw
  modified_base (263)..(263): a, c, t, g, unknown or other
  modified_base (378)..(378): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaanagaaacctgccaggctcccaggctcctcatctatgatgctatttaggacgggccactggcctacgtccccaccctaggttcacgtgcgagtgggtctggggacagacttcattcncaccatccgcacgcctagacgcctagaagtatttgacttagtttacttacgtagtacaacgtagtcgttaacgactaacgcgacggtacccgtcccgggtacgtacccggttccggaccggtaaacggggacccgtaaagggtacgggaaacgtacggaaaacggtaccggtaaaacgttcgggtacgggtaccgtacggtacccgaaccttaacgttacccgttcggttacctttaccgtaaccgtttccccgttacccccggtaaccgttctttacccg

SEQ ID NO: 441801 - DNA, 521 bp, Homo sapiens
  misc_feature: GZ8MTXP02FHJ6X.11.57.F02.1.454.CMB.2.raw
  modified_base (257)..(257): a, c, t, g, unknown or other
  modified_base (305)..(305): a, c, t, g, unknown or other
  modified_base (401)..(401): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccgcggtctttgcttggcattangcacctcacgccgtcacgtaccagttgaacttgacctcaggtcttcgngctcacgtccaccacacgcatgtgacctcgaggggtccgcaggctcccgaggtaacggggctaggaatggatttcgatacattagcagtagtggtncgacatatactagcagactctgtgaaggccgattcatcatctccagagacaatcggacaacactcactgtatctaggaaacttacaaacagtccaagagacgtacgaggacaccggctag

SEQ ID NO: 441802 - DNA, 577 bp, Homo sapiens
  misc_feature: GZ8MTXP02HQMNA.11.57.F02.1.454.CMB.2.raw
  modified_base (261)..(261): a, c, t, g, unknown or other
  modified_base (402)..(402): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaatattaacaactacttagcctggtccaanagaaacctgcagctccagctctcatctatgatgctagtttaggacgggccactggcactccccaccgtaggttcagtggctaggtgggtctggggacagtctctattctcaccatccgcacgcctagacgcctagtaagtntttgacttagttttatactgtacaacgtagacgtagcaacgcgacggtcctcccgggtacgacggttaccggaccgaaacgggaccgaaagggtggaacgtacgacggtacgacgttggcggtctacggaccacctatcgttcgttactactaccttcctacccgcctaattccg

SEQ ID NO: 441803 - DNA, 705 bp, Homo sapiens
  misc_feature: GZ8MTXP02GQO1P.11.57.F02.1.454.CMB.2.raw
  modified_base (287)..(287): a, c, t, g, unknown or other
  modified_base (409)..(409): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatataacaactacttagcctgttaccaacagaacctgccaggcctccaggctcncatctatgatgactagtttaggacgggcccacgtggccactcccccaacccgtagggtttccaggttcggcgtaggtcggggtactcggggacacggtacttcattcctcacctatcccganacgtcctaaggacgccttaagacgttaagttttcgacgttaagtttttactacgttacggttaccaaaacgtacggtacccgttaagaccgaacggaccgtaaccggggtccccgtacccggggaccgggttaccggttacccgggaacccggaaaaccgggggtaacccggtaaagggggttacgggaaacgttaccgaaaacggtaccgggtaaacgttggtacgggacttacggaccaaccgtacgttcgtcgtttcctaacgttcttaccctttccccgactaactttccgg

SEQ ID NO: 441804 - DNA, 638 bp, Homo sapiens
  misc_feature: GZ8MTXP02GV8QG.11.57.F02.1.454.CMB.2.raw
  modified_base (205)..(205): a, c, t, g, unknown or other
  modified_base (442)..(442): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactacttagcctgttccaacagaacctggcaggctccaggctcctcatctatgatgctagtttaggagggccactggcactccccaccaggttccagtggctaggtgggtctaggggacagtacttcattctacaccactccgcacgcctagacgcctagaagtatttgacttagtttattacgtcgtactaaacgngtacgtagacgagcgacggtccgtccgggacggtaccgttccggaccggaaacggggtacgtaaaggggtcggtaaacgtacgaaaacggaccggtaaacggtggtacgggtacttacggaccctaaccgtaacggttaccttcggtttacccgtttactaccgtttccccgtttccccgaccttaacgtttcccg

SEQ ID NO: 441805 - DNA, 736 bp, Homo sapiens
  misc_feature: GZ8MTXP02F0BR3.11.57.F02.1.454.CMB.2.raw
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaattattaaataactacttagcctggttaccaacagaaacctggccaggctcccaggcctctcatctatgatgctagtttaggacgggtccacgtcggcaactccccaacccgtaggttccaggttcggccaggttcggggtctaggggaacctaggtactttcgatttccgcaccctatcccggctacgcccttaaggacgtccctagtaaagttatttttgacgttaagttttaacttactagttaccaaacgtacgtacgttaacgacgaacggtaccgtaaccggggccccgttcccggggaccgggttaaacccgggttccgggaaacccggtaaaacgggggtaaccccgaaaagggggttacggaaacggtaccgaaaggaaccggtaaaccgtggggtaccgggtacttacggacccgtaaacccgttcgtttacgttcgtttaacccgtttaccgttacccgtttaccccggttaccccgtaccttacgtttaccg

SEQ ID NO: 441806 - DNA, 591 bp, Homo sapiens
  misc_feature: GZ8MTXP02FMXAC.11.57.F02.1.454.CMB.2.raw
  modified_base (450)..(450): a, c, t, g, unknown or other
  modified_base (549)..(549): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggcccggggggtcctgacgactctcctgtctagtctcgtggattcgccttcagtgactatcgccataggaaggtcggtcccgccgaggcctacccggaagggtaaggggctagggaatggtatttcgatactattacgctagtagtggtgaccgaacctatatactacgacagtactcgtagtaggaacggtcccgtatccatctatccctacgaaganaacagtcggaacaaacaactcacttagtactacgtaagaaactacgaacacgaccgtaggaacgacgtacggaaggtaccgacggtcttagttaacgtntttagtgtcgacgacgaccgtacccccgtaggtcgtaaccgg

SEQ ID NO: 441807 - DNA, 726 bp, Homo sapiens
  misc_feature: GZ8MTXP02GHSH2.11.57.F02.1.454.CMB.2.raw
  modified_base (286)..(286): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaattgtgttgacacagtctccggccaccctgtctgcgtctccgtaggggaaacagtccaccctctcctgcgagggccagtacaaaatataaacaactactagcctgtaccaacagaacctgcaggctccagctcncatctatgatgtactaggtttaggacggacctacgtgaccacctaccccgaaccgtaggttccgaggtggacgtaggttggtcgtacgggaactacgtacttcgtacttaccacacccgtactccgacgacgtacctagacgtactagtaaagtttagtttacgtaacttagttttaactacgtacgttaacaacgtacgtacgttagaccgttagaccggtaccgggtcccggtacccgggtaccgggttaacccggttacccgggaaacccgggtaaacggggtaaacccgggtaaaaggggttaaccggtaaaacgggttaccggaaaacggtaaccggtaaaacgttccggggtaaacggtccgtacggaaccctaccgttacgttccgttccgttaccgttactaccttccccggttaccctcgttaaacttccg

SEQ ID NO: 441808 - DNA, 526 bp, Homo sapiens
  misc_feature: GZ8MTXP02G7BRN.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttcagtgactatgccatgaagtgggtccgccaggctccaggtaaggggctggaatggatttcatacattagcagtagtggtgcgacatatactacgcagactcgtgtagaagggcccgattcatcatctccagagacaagtggacaaacactcactgtatcgagaaatcgaaacagacctagagacgtcggaaggacgacggctagtaattattaagttgtgtacgagaccgcccccgtaggtcgtaccgg

SEQ ID NO: 441809 - DNA, 635 bp, Homo sapiens
  misc_feature: GZ8MTXP02HU6ZS.11.57.F02.1.454.CMB.2.raw
  modified_base (300)..(300): a, c, t, g, unknown or other
  modified_base (311)..(311): a, c, t, g, unknown or other
  modified_base (356)..(356): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgcggtctttgtcttggcattatgcacctccacgccgtccacgtaccagttgaacttgacctnagggtcttcgnggctcacgtcccaccaccacgcatgtcgacctcgaggggtccccnccgaggcctaccgaggggtacgggctaggaatggtactttcatactagttacgcgtaggtaggtggtcgaccgtaacctaattaactaccgtacgacacgtacgtcgtaggtacggaacggtacctacttacacttctactaccaccgaagacgaacaagtacggaacctaaacctaacctactacgttagttaactaccgtaaaggtaaaactaccgaaacgtacgtaccgtaaggaacggtacggtacggaacggtaaccgtacggttacgttaacg

SEQ ID NO: 441810 - DNA, 540 bp, Homo sapiens
  misc_feature: GZ8MTXP02HXE75.11.57.F02.1.454.CMB.2.raw
  modified_base (368)..(368): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggaggcttagtccaggccggggggtccctgagactctcctgtctagtctctggattcgccttcagtgactatgccatgaagtgggtccgccaggcctccgaggtaaggggctggaatggatttcatacattacgcagtagtggtgcgaccntatactacgcagactcgtgtgaggcattcatcatctcagacgacataggacaaacactacactagtatacgtagaactacaacagacctagaacgtacgacggtacggacgacggacttacgtacttagtttagttgtgacgtacgaccgacccccgtacggtacgtaccgg

SEQ ID NO: 441811 - DNA, 558 bp, Homo sapiens
  misc_feature: GZ8MTXP02HOJED.11.57.F02.1.454.CMB.2.raw
  modified_base (277)..(277): a, c, t, g, unknown or other
  modified_base (366)..(366): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctatttagaggtgtccagtgcgaggtgcaagtggtgcagtcgtgggggagcttaggtccaggccggggggtcctgagactctcctgtctagtctctggattcgccttnagtgactatgccatgaagtgggtccgcaggctccgagggtaaggggctgggaatggtatttcatacattacgctagtgtggtgccgacntatactacgcagactcgtggtagaacgggcccgtattcattcatcctaccagagacaagtcggacaaacactcactagtactcgtaaggaaactacaaacacgaccgtaggagtaacggtacggaaggaccacgggtcttacggtacttattaagtggtgacggtacgaccgtcccccgtaggtacgaccgg

SEQ ID NO: 441812 - DNA, 605 bp, Homo sapiens
  misc_feature: GZ8MTXP02JCRX7.11.57.F02.1.454.CMB.2.raw
  modified_base (130)..(130): a, c, t, g, unknown or other
  modified_base (261)..(261): a, c, t, g, unknown or other
  modified_base (371)..(371): a, c, t, g, unknown or other
  modified_base (377)..(377): a, c, t, g, unknown or other
  modified_base (428)..(428): a, c, t, g, unknown or other
  modified_base (438)..(438): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactcnggctcccagataccaccggagaaattgtgttgacacagtctccggccaccctgtctgcgtctccgtggggaaacagtcaccctctcctgcagggccagtcaaaatataacaactacttagcctggtccaanagaacctggccaggctccagctctcatctatgatgacatttaggaggccatggcactccccactaggttcagtggcaggtcgggtctaggggacagtactttcatttccncaccgntccggcagcctagacgcctagaagtattttagcggtaaattttacttacgngtaacaacgngtacgtacgacgacgacggccggtcccgccgggacggtaccgtaccggaacggaacggaacggtaggtaacggtaacgtaacgaacggacgtacggtggaccggtcgtacgacccgaccgtacgttcgtcgttcttactaccttaccccgtccccgaactacgttcg

SEQ ID NO: 441813 - DNA, 528 bp, Homo sapiens
  misc_feature: GZ8MTXP02IDOTH.11.57.F02.1.454.CMB.2.raw
  modified_base (364)..(364): a, c, t, g, unknown or other
  modified_base (374)..(374): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgctgggttttccttgttgcttattttagaaggtgtccagtgcgaggtgcaagtggtgcagtcgtgggggagcttagtccaggccggggggtcctggagactctcctgtctagtctctggattcgccttcagtgactatgccatgaagtggtccgcaggctccgaggtaagggctggaatggatttcatacattacgcagtagtggtgacgactntatactacgnagactctgagaagggccgattcatcatctccaagagacaatcggacaaacactacactgtactcgtagaaatcaacagcctagagacgtacgaggacacggctagtacttattagtaagtcgacgtacgaccgtcccccgtaggtacgtaccgg

SEQ ID NO: 441814 - DNA, 698 bp, Homo sapiens
  misc_feature: GZ8MTXP02G8CNA.11.57.F02.1.454.CMB.2.raw
  modified_base (203)..(203): a, c, t, g, unknown or other
  modified_base (258)..(258): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaatattaacaactacttagctgtccaanagaactgcagctccagctctcatctatgatgactagtttagggacgggccacgtggccactccccacccgtagggtttccaggtcggcgtagggtcggggtctcggggacaggtacttcatttcctcacctactcccgactacgcctaggacgtacccgtagtaacgttagttttagaccgtttaagttttaacttacgttacgtacgtaaacgtacggtaccgtagaccgacgaccggtaccgggtaccccggtacccggggtaccgggttacccggttacccggggaacccgaaacgggggtaacccgtaaagggggtacggaaaccggtacgaaacggtaccggtaaaccgtgggtacggtaccgttacggaccctaaccgtaggttccttaacggttcttaccctacttcccgtccccgtaccgttacttacccgg

SEQ ID NO: 441815 - DNA, 596 bp, Homo sapiens
  misc_feature: GZ8MTXP02JKVPC.11.57.F02.1.454.CMB.2.raw
  modified_base (204)..(204): a, c, t, g, unknown or other
  modified_base (459)..(459): a, c, t, g, unknown or other
  modified_base (537)..(537): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaaatattaacaactacttagcctggttaccaacagaaacctggccaggctcccaggcctcctcatctatgatgactagtttaggagggccagtcggcactccccacctaggttccaggtcggacaggtcggggtctacggggacagtacttcgattcctacacctactcccggacacgccttagacgcctagaagtgttttgacttagtttacttatcgtactaacgngacgtagacagcgacggtcctccgggcgtacggtccgacgtaacgggacgaagggtcggaagtacgaacgacgtacgnggtcgcgtacgccacctacttcgtaacgttcttctactccgtttacccgctacttaccg

SEQ ID NO: 441816 - DNA, 588 bp, Homo sapiens
  misc_feature: GZ8MTXP02IJ1PA.11.57.F02.1.454.CMB.2.raw
  modified_base (204)..(204): a, c, t, g, unknown or other
  modified_base (289)..(289): a, c, t, g, unknown or other
  modified_base (385)..(385): a, c, t, g, unknown or other
  modified_base (391)..(391): a, c, t, g, unknown or other
  modified_base (479)..(479): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtccacctctcctgcagggccagtacaaaatattaacaactacttagcctggttccaacagaaacctggcaggctccaggctccncatctatgatgctagtttaggaggggcccactcgggcactccccaccgtagggttccaggtcggcaggtgggtctggggacagtacttcactttcncaccgntcccgcacgtccctagacgtcctagtaagtattttgacttagttttattacttcgtactaacagacgtagcagcgacggcctccgggngtaccgtccggacgaacgggacgaagggtagaacgtacgaacggtacgaagtggacgtctacggccacgtattcgtgttcttacgtacttaccttcccgtactactccg

SEQ ID NO: 441817 - DNA, 719 bp, Homo sapiens
  misc_feature: GZ8MTXP02H05VF.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggcagtacaaaatattaacaactactagcctggttccaacagaaactggaccaggcctccaggcctcctcatctatgatgctagtttaggacgggccacgtggccactccccaccgtaggttcaggttcgtcgtagggtggggttctaggggacctagtaccttcgtaactttcctaccaccgtacttcccgacaaccgtacctaggtacgtcccttaaggtaaagttacgttttgaccgttaagtttttaactttacgtacgtacctaaacgacggtcgtagacgtaggccgtaacgggtccccgtaccggggacggtacccgggttaccgggaaccgtaaaacgggggtacccgaaaaggggtacgggtaaacgtacggaaaacggtaccggaaaaccggttggggtacggaccgttacggacccgtaaccgtagtcccttaacggttccttttaaccgaccctttcccggtttacccccgtacctaacgttccgg

SEQ ID NO: 441818 - DNA, 597 bp, Homo sapiens
  misc_feature: GZ8MTXP02H2K0S.11.57.F02.1.454.CMB.2.raw
  modified_base (258)..(258): a, c, t, g, unknown or other
  modified_base (301)..(301): a, c, t, g, unknown or other
  modified_base (347)..(347): a, c, t, g, unknown or other
  modified_base (365)..(365): a, c, t, g, unknown or other
  modified_base (380)..(380): a, c, t, g, unknown or other
  modified_base (391)..(391): a, c, t, g, unknown or other
  modified_base (421)..(421): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactactagctgtcaanagaactgcaggctccagctctcatctatgatgctagtttaggngggccacgtggcactccccaccctaggttcagtggcaggtgggtcngggacagcttcattctcncatccgcagcctagnccctagaagtntttgcttagtttactttactgtacaaacgngtacgtagacaggaccacgggtcccgtcccgggaccggtaccggttaccggaccgtaaacgggacccggaaagggttacgggaaacgtacgaaaggccgaaaggtcggtacggtcgtacgaccgtacctagtccgttaacggttccttactacgtcccttccccgacgtaacttcg

SEQ ID NO: 441819 - DNA, 631 bp, Homo sapiens
  misc_feature: GZ8MTXP02GRLGO.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgctattttagaaggtgtccagtgcgaggtgcaagtggtgcagtcgtgggggagcttagtccgagggccggggggtccctgagactctcctgtctagtctctggattcgccttcagtgactatcgccatgaagtcgggtccgcaggcctccgaggtaaggggctagggatggtatttcatacattacgactagtagtggtcgaccgaactatactaaccgtacgcaagtaccttcgtagggtaggaacggggtccctaattaccagttacctacttccgtaccgaaggtaacgaacctaagtacggaaccaaaactaacctcgtaccttaggtaactccgtaaggaaaacttccgaaactcgtaccgtaagacggtaacggtcggaaacggacgtaacggtacttaggtacttaagtttagtgtacgacgacgtaacccgccccggttaggtaccgtacccggg

SEQ ID NO: 441820 - DNA, 592 bp, Homo sapiens
  misc_feature: GZ8MTXP02I46N6.11.57.F02.1.454.CMB.2.raw
  modified_base (262)..(262): a, c, t, g, unknown or other
  modified_base (284)..(284): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcacctctcctgcagggccagtacaaaatattaacaactacttagcctggttccaanagaaacctgcagctccagctcncatctatgatgcatttaggagggccacgtggcactccccaaccaggttccagttggctaggtcgggtctgggacagtacttcgatttccncgcctatcccgcagcctagacgtccctagtaacgtatttgactaagttttattaacgtgttacaaacgtagtacgtagtcgaagtcgacgtcccgtaccgggtccgaaccgttccgggaccgaaacggggaccgaaagggtcggaaagtacgaaaggcgtaaacgtggtacggcgtcgacgaccattcgtgttactctactccttcccgctacgttcg

SEQ ID NO: 441821 - DNA, 640 bp, Homo sapiens
  misc_feature: GZ8MTXP02JC3K0.11.57.F02.1.454.CMB.2.raw
  modified_base (206)..(206): a, c, t, g, unknown or other
  modified_base (272)..(272): a, c, t, g, unknown or other
  modified_base (377)..(377): a, c, t, g, unknown or other
  modified_base (398)..(398): a, c, t, g, unknown or other
  modified_base (595)..(595): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtagggaaacngtccaccctctcctgcagggccagtacaaaatattaaacaacttacttagccttggttacccaaanaacgaaaccgtggacccaaggcctcccaggcctcctcatctatgatgactagtttaggacggccacgtggcactccccaccgtaggttcagtggcaggtgggtcnggggacagtacttcattcacnccatccgcacgcctagcgtcctagaattctttgacttaagttttacttaacgtgtacaaagtacgtacgtacgacgtacgcgaacgggtcccgtaccgggacgggtaccgttaccggacggaacgggaccgtaaggggtaggaaacggtacgaaaggaccggtaaagttcggtcggtaacgtcggtcctaaaccgtnttacgtcggttaccttctacgtttccgtaccccgtctacgtttcg

SEQ ID NO: 441822 - DNA, 696 bp, Homo sapiens
  misc_feature: GZ8MTXP02GGJD3.11.57.F02.1.454.CMB.2.raw
  modified_base (204)..(204): a, c, t, g, unknown or other
  modified_base (265)..(265): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttaccaanagaaacctggccaggctccaggctcctcatctatgatgctagtttaggacgggccacgtggacactccccgaaccgtagggttccaggtcggacgtaggtggggtctcggggacaggtacttcagttcctacacctactcccggacacgtacccttaaggacgtcccgttagtaaacgttatttttcgacgttaagttttaacttacgtcgtaacaaacgtaggtacgttagaccgaacggtaccgaacgggtccccgtaccggggtaccggtaacccggttcccgggaacccggaaaagggggtaaccccgtaaaggggtacggaaacgtacgaaacggtaccggtaacgtgggtacggcctacggaccctaacgtacgttccgtcgttaccttaccgtaccttcccgtttaccccggctaacgtttccg

SEQ ID NO: 441823 - DNA, 757 bp, Homo sapiens
  misc_feature: GZ8MTXP02JVZNG.11.57.F02.1.454.CMB.2.raw
  modified_base (204)..(204): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgtgtctcctggggaaacngtcaccctctcctgcagggccagtcaaaatataacaactacttagcctggttccaacagaaacctggccaggctcccaggctcctcatctatgatgcatttaggagggccactggcatccccaccaggttcagtggcagtgggtctggggacagtacttcattctcacctatccgcacgcctagacgtccctagaaacgtagtttttggcttaaggtttttaactttaactttcggttacctaaaacgtacggtaccggttaacgaccgtaaacggtcccgaaccgggggtacccccgttccccgggggtacccgggtaacccgggttttacccggggaacccccggtaaaacgggggaaccccggtaaaacgggggttcggggtaaaaacggtttacccggaaaaacgggtacccggaaaaacccggttggggttaaaccggggccggtttacgggaacccgaaaccccgttaacgttacccgttaacggtttcccttttacccggtaactttacccccgtttcccccggaaccccttaacgtttaccccgg

SEQ ID NO: 441824 - DNA, 554 bp, Homo sapiens
  misc_feature: GZ8MTXP02GSJSI.11.57.F02.1.454.CMB.2.raw
  modified_base (240)..(240): a, c, t, g, unknown or other
  modified_base (362)..(362): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgnggtctttgtcttggctattatgccacctccacgccgtccacgtaccagttcgaacttgacctcgagggttcttcggtgctcaccgtccaccaccacgcatcgtcgacctcgacggggtcccncaggcctaccgagggtaacgggctaggaatggtattcatacatagctagtagtggtgcgaccatactacacgcacgactcgtagtacgaaggtccgattcatcactctacagagacaagtcgaacaacactctactgtactcgtaagaactacaacagactaagaacgacgtacggacgacgacggacttag

SEQ ID NO: 441825 - DNA, 576 bp, Homo sapiens
  misc_feature: GZ8MTXP02JKQ69.11.57.F02.1.454.CMB.2.raw
  modified_base (204)..(204): a, c, t, g, unknown or other
  modified_base (311)..(311): a, c, t, g, unknown or other
  modified_base (323)..(323): a, c, t, g, unknown or other
  modified_base (368)..(368): a, c, t, g, unknown or other
  modified_base (378)..(378): a, c, t, g, unknown or other
  modified_base (389)..(389): a, c, t, g, unknown or other
  modified_base (424)..(424): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttccaacagaaacctggccaggctcccgagctctcatctatgatgcatttaggnggccactggcancccaccaggttcaggtgcagtggtctgggacagacttcattctcncctatcccgnacgcctagacnccctagaatatttgctagtttatactgttacaacngtacgtagacagtacgaggccctccgggcgtacggttccggaccgaacggggacccgaaagggtacggtaacgacgaagacggtaaacgtgggtacggccgttacggaccaccgtatcgtcgtacttcgtactccttccccggtccagttcg

SEQ ID NO: 441826 - DNA, 569 bp, Homo sapiens
  misc_feature: GZ8MTXP02I19ZI.11.57.F02.1.454.CMB.2.raw
  modified_base (352)..(352): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggtctttgtcttggctattatgcacctccacgccgtccacgtaccagttgaacttgacctcgaggtcttcgtgctcacgtccaccaccacgcatgtgacctcgacggggtccnccaggcctacccgagggtagggctaggaatcggatttcatactattagctagtagtggtgcgacatatactacgcacgactcgtagtacgaggaccgtattcgatcatctaccaagacgaacagtcgaaaaacacaactcacttagtactcgtaaaggaaacttacgaaacgacgtaccgtaaggagaacggtcggaacggacgacggtacttaagg

SEQ ID NO: 441827 - DNA, 622 bp, Homo sapiens
  misc_feature: GZ8MTXP02G0PDK.11.57.F02.1.454.CMB.2.raw
  modified_base (203)..(203): a, c, t, g, unknown or other
  modified_base (288)..(288): a, c, t, g, unknown or other
  modified_base (371)..(371): a, c, t, g, unknown or other
  modified_base (378)..(378): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaattgtgttgacacagtctccggccaccctgtctgcgtctcctggggaaacngtcaccctctcctgcagggccagtacaaaatattaacaactacttagcctggttccaacagaacctgccaggctccaggctcctnatctatgatgctatttaggacgggccacgtggccactccccaccagggttcaggtggcgaggtgggtctcggggacagacttnactttcncaccatcccgacacgcctagacgcctagagttatttgactagtttatactgtacaactgacgtagacagtcgacggtcccgtaccgggacggtaccggttccggaaccggaacggggaacccgtaaaggggtacggaaaggtaccaaacgggaccgtaaacggttggtacggccgttagacctacccgtagttccgtaacgttccttacctacgtttccccgtttacccgacctacgtttaccg

SEQ ID NO: 441828 - DNA, 585 bp, Homo sapiens
  misc_feature: GZ8MTXP02HCSF3.11.57.F02.1.454.CMB.2.raw
  modified_base (261)..(261): a, c, t, g, unknown or other
  modified_base (283)..(283): a, c, t, g, unknown or other
  modified_base (287)..(287): a, c, t, g, unknown or other
  modified_base (370)..(370): a, c, t, g, unknown or other
  modified_base (389)..(389): a, c, t, g, unknown or other
  modified_base (500)..(500): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcacctctcctgcagggccagtcaaaatattaacaactacttagcctggttccaanagaaactgccaggctccaggcncctnatcatgatgctatttaggaggccatggcatccccacctaggttcaggtcgctaggtggtgtcgggacagacttctagttctcncactccgtcagcctagacncctaggaacttatttgactagtttatactgtacaaacgtgacgttagaccagtacacggtcccgtccgggacggtaccggttaccgggacgaaacggggaccctaaagggnggtaaacgtacgaaagtacggaaactggtacggacgtcgacgaccattccgtgtttacctacgactttccgaccctacacttacg

SEQ ID NO: 441829 - DNA, 578 bp, Homo sapiens
  misc_feature: GZ8MTXP02GGVTR.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctatttagtaaggtgtccagtgcgaggtgcaagtggtgcagtcgtgggggagcttagtccgaggccggggggtccctgagactctcctgtctagtctctggattcgccttcagtgactatgccatgaagtggtccgcaggctccaggttaaggggctagggaatggtatttcatactattacgcagtagtggtgaccgacagtatacgtaacgcaagactctggtgaaggccgattcatcatctacagagacaagtggacaaacgactacactagtaactcgtaaggaaacttacaaacacgtacctagaacgacggttacgaacgggacaaccggtctacggttaacttagtttaattggtacgaccggtaacggaccgtaccccccgttaagggtcgtaaccccggg

SEQ ID NO: 441830 - DNA, 596 bp, Homo sapiens
  misc_feature: GZ8MTXP02IGKZI.11.57.F02.1.454.CMB.2.raw
  modified_base (203)..(203): a, c, t, g, unknown or other
  modified_base (368)..(368): a, c, t, g, unknown or other
  modified_base (370)..(370): a, c, t, g, unknown or other
  modified_base (373)..(373): a, c, t, g, unknown or other
  modified_base (389)..(389): a, c, t, g, unknown or other
  modified_base (437)..(437): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggtccaacagaaacctgcaggctcccaggctcctcatctatgatgctatttaggagggccatggacatccccaccaggttcagtggctaggtgggtctggggacagacttcattcncnccntccgcacgcctagacncctagtaagtattttgctagtttattactgtacaacagtacgtagacngcaggcccgtccggacgtacgttcggaccgtaacggggacctaagggtaggaacgtacgaaaacggaccgtaaacgttggacggtacgtacgaccgtaactacgttccgttaacgttaccgtttactaaccgttcctttacccccgaccttaacttccg

SEQ ID NO: 441831 - DNA, 538 bp, Homo sapiens
  misc_feature: GZ8MTXP02F4JU1.11.57.F02.1.454.CMB.2.raw
  modified_base (260)..(260): a, c, t, g, unknown or other
  modified_base (351)..(351): a, c, t, g, unknown or other
  modified_base (507)..(507): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgcggtctttgtcttggcattangcacctccacgccgtccacgtaccagtgaacttgacctcaggtcttcgtgctcacgtcccaccaccacgcatgtcgacctcgacgggtccncaggcctcccgagggtaacgggctaggaatggtatttcatacattagctagtagtggtgacgaccatatactacgacagactcgtgtagaacgggcctatcatcatcacaagagacaagtcgacaaacactcactgtatacgagaaactcaaaacncgacgaagacgacgacgacggacgacgctag

SEQ ID NO: 441832 - DNA, 544 bp, Homo sapiens
  misc_feature: GZ8MTXP02GBDBB.11.57.F02.1.454.CMB.2.raw
  modified_base (361)..(361): a, c, t, g, unknown or other
  modified_base (371)..(371): a, c, t, g, unknown or other
  modified_base (503)..(503): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctataatgcatttaggaggccagtggcatcccaccaggttcagtggcagtggtctgggaccagacttnattctcaccntccgcagcctagacgcctgaagtatttgctagtttattacgtgtacaacagcgtagcgtagcacggtccctccgggcgtacggttccgccgaaaggggaccaagggtacggaagtacgaagcgaaacgtggnggctggcaccgatctagtcttcatccttcccgctatcgtag

SEQ ID NO: 441833 - DNA, 521 bp, Homo sapiens
  misc_feature: GZ8MTXP02F4X4D.11.57.F02.1.454.CMB.2.raw
tcagcgagagataccacgaccggtgctcgatttagctcgatatagttgggtttggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttcagtgactatgccatgaagtgggtccgccaggctccaggtaggggctggaatggatttcatacattagcagtagtggtgcgaccatatactacgcagactctgtgaagggccgattcatcatctccagagacaatggacaacactcactagtatctaggaatcaacagcctagaagacgtcgacggacgaccggctagtacgtattattgttagcgtacgacgtacccccgtacggtcgtaccgg

SEQ ID NO: 441834 - DNA, 683 bp, Homo sapiens
  misc_feature: GZ8MTXP02I5PYB.11.57.F02.1.454.CMB.2.raw
  modified_base (286)..(286): a, c, t, g, unknown or other
  modified_base (293)..(293): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactgctcccagataccaccggagaaattgtgttgacacagtctccggccaccctgtctgcgtctcctggggaaacagtccacctctcctgcagggccagtacaaaatattaacaactacttagcctggttaccaacagaaacctgcaggctccagctcncatctancgatgctagtttaggagggtcccagtggacctactcccccgaaccgacggtttccaaggttcggcgtaaggtcggggtcgtacggggaaccgagtactttctaactttcccaccacccgtaacctccggacctacgtacccttaaggacgtcccgttaagaaaggttaactttttcgaactttaaggtttttactttaacgttcgttaaccgaaacgtaggtaccgtaaggtaccgaagtaccggacggtaccccgttccgggacggtaacccggttacggaccggaaacggggtaacccgaaaagggtcggtaaagtacgaaacggtacgaacgtggtacggactacggcaaccctgtccttgtctacgtcctacctcctacgtactcg

SEQ ID NO: 441835 - DNA, 532 bp, Homo sapiens
  misc_feature: GZ8MTXP02JT110.11.57.F02.1.454.CMB.2.raw
  modified_base (372)..(372): a, c, t, g, unknown or other
  modified_base (408)..(408): a, c, t, g, unknown or other
  modified_base (451)..(451): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccgggggggtccctgagactctcctgtctagtctctggattcgccttcagtgactatgccatgaaggtcgggtccgccaggctccgagggtaaggggctggaatggatttcatacattacgcagtagtggtgcgacatanactacgcagactctgtagaaggccgattcatcatcncagagacaatgacaacactcactgtatcgtaggaaactcaacngacctagagacgtacgaggacacgggactagtattattagtaacgtgtacgacggaccgtacccccgtaaggtcgtaccgg

SEQ ID NO: 441836 - DNA, 615 bp, Homo sapiens
  misc_feature: GZ8MTXP02HK244.11.57.F02.1.454.CMB.2.raw
  modified_base (260)..(260): a, c, t, g, unknown or other
  modified_base (355)..(355): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgcggtctttgcttggctattangcacctccacgcctccacgtaccagttgaacttgacctcgaggtctcgtcgctcacgtccaccaccacgcagtgtacgacctcgacggggtcccnccgaggcctaccccgaagggtaacggggctaggaattggtaatttcgaatacattagctaggtagtggtcgtacgaccataactactacgactagactcgtagtacggaacgggtcctatttacactttacaactccgttacccgaagtaacgaacaaagttacggaaccaaacctaacttaccgaacttaggtaacttaccgtaaggaaaactaccaacgtacgaccgaagagacggtacgaggaccaacggtcttaag

SEQ ID NO: 441837 - DNA, 669 bp, Homo sapiens
  misc_feature: GZ8MTXP02J2LH3.11.57.F02.1.454.CMB.2.raw
  modified_base (203)..(203): a, c, t, g, unknown or other
  modified_base (212)..(212): a, c, t, g, unknown or other
  modified_base (260)..(260): a, c, t, g, unknown or other
  modified_base (385)..(385): a, c, t, g, unknown or other
tcagcgagagataccacgaccggtgctcgatttagctcgatatagttgggtttgggggaggaactgctcagttaggaccagagggaaccatggaagccccagctcagcttctcttcctcctgctactctggctcccagataccaccggagaaattgtgttgacacagtctccggccaccctgtctgcgtctcctggggaaacngtcaccctntcctgcagggccagtcaaatattaacaactacttagctggttccaacngaaacctggcaggctccaggctctcatctatgatgacatttagggacggggcccactcgggcattaccccacccaagggtttccaaggttggctaggtggggtctggggcagacttcattcctcncaatccgcagcctagagccctagagtattttgactagtttaatttactagttcaaacgaggtacgtagcacgtcgacggtccccgttcccgggccggtaccggtttccggggaccaaacgggggaccaaaacgggggttacgaaaacgggttacgaaaacggtccggaaaacgttggtacgggacccgttacggtaacccgaacccgtaaactccgtttaacggtccttttttacccgaaactttacccctttttcccccggaccctaaaccgttttaacccgg

SEQ ID NO: 441838 - DNA, 632 bp, Homo sapiens
  misc_feature: GZ8MTXP02FQ1LF.11.57.F02.1.454.CMB.2.raw
  modified_base (413)..(413): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatacttaacaactacttagccttggttacccaacagaaaccctggcccaaggcctcccaggcctctcatctatgatgcagtttaggacggccacgtggaccagtcccccaaccgtagggttccaggttcgcgtaggtgggtcgtagggacctagacttcatttcgacaccagtcccganaacgtcctagacgcctagaagtctttagacttagtttattactagtacaaacgtgacgtacgacaggaccaaccggggtcccttaccgggaccggtaccggttacgggacccgaaacggggaaccgtaaaggggagaaacgttacgaacgtaccggaacgttacgggtggactacgaccaacgtcttcgtcgtacttcactcctttcccgactactttc

SEQ ID NO: 441839 - DNA, 579 bp, Homo sapiens
  misc_feature: GZ8MTXP02GEZH5.11.57.F02.1.454.CMB.2.raw
  modified_base (259)..(259): a, c, t, g, unknown or other
  modified_base (266)..(266): a, c, t, g, unknown or other
  modified_base (283)..(283): a, c, t, g, unknown or other
  modified_base (365)..(365): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcacctctcctgcagggccagtacaaaatataacaactacttagcctgtaccaanagaaccngccaggctccagctctnatctatgatgctagtttaggaggccacgtggcactccccaccgtaggttcagttggctaggtcgggtctgggacagtacttnacttcctcaccgactccggcagcctaagcgtcctagtagtatttgactagtttatacgtgtacaacgtgacgttacgacgtacgcgtacggccgttccgggcgtacggttaccgaccggtaacgggacgtaaggtgaacgtcgaaaggtccgaattcgggcgtacgtcgaccactactcgtcgttcctactaccgttccgtaccgtctacttcg

SEQ ID NO: 441840 - DNA, 513 bp, Homo sapiens
  misc_feature: GZ8MTXP02IT40J.11.57.F02.1.454.CMB.2.raw
  modified_base (361)..(361): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttcctgttgctattttagaaggtgtccagtgcgaggtgcaagtggtgcagtctgggggaggcttagtccaggccggggggtccctgagactctcctgtctagtctctggattcgccttcagtgactatgccatgagtgggtccgccaggctccaggtaaggggctggaatggatttcatacattagcagtagtggtgcgacntatactacgcagactcgtgtgaggccgatcatcatcctcagagacatgacaacaactcactgtactctagaaactcgaaacagcctgagacgtcggaggacgacggctgtattagttatgtcgacgacgaccgcccccgtaggtcgtaccgg

SEQ ID NO: 441841 - DNA, 745 bp, Homo sapiens
  misc_feature: GZ8MTXP02G88VC.11.57.F02.1.454.CMB.2.raw
  modified_base (204)..(204): a, c, t, g, unknown or other
  modified_base (253)..(253): a, c, t, g, unknown or other
  modified_base (294)..(294): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtacaaatataacatactagctgtcanagaactgcagctccagctctcatctatgatgcagtttaggngggccagtcggcactccccaccgtacggttccaggtcggcgtaggtcggggttcgtacggggactacggtacttctactttcctacacccgactccgacgacgtcccgtaaggacgtcccgtaagtaacgttactttttacggaccgtttaagttttaaccgtttacgttacggtaacctaaacgtaacgggtacgttaacggtacgtacggaccgtaaccggggtccccgttacccggggaccgggttacccgggttaccccggggaaccggaaacgggggtaaccccggtaaaagggggttacggggtaaaaccggttaccggaaaacgggtaaccggtaaaccggttgggtcccgggtacgttacgacccggtaaaccgtctttaacccggtgtttacccttaaccggtaccgtttcccctttaccccggaccttacgtttaacccgg

SEQ ID NO: 441842 - DNA, 577 bp, Homo sapiens
  misc_feature: GZ8MTXP02GB03S.11.57.F02.1.454.CMB.2.raw
  modified_base (204)..(204): a, c, t, g, unknown or other
  modified_base (431)..(431): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtccaccctctcctgcagggccagtcaaaatattaacaactacttagcctggttccaacagaaacctggccaggctcccaggcctcctcatctatgatgacagtttaggagggtccacgtggccacgttcccccaaccctagggttccaggttcggactaggtgggtctggggacagtacttcattcctcaccactccgacacgccctaagacgtcctagaaacgtntttgacttagtttaattactgtacaacgagcgtaagcagcaggtcctcggcgtacgttccggacgaagggtaccgaaggtacggaagtacgaagcgaacgtggtcggactcgcaccgatctcgtcttcactccttcccgctactcg

SEQ ID NO: 441843 - DNA, 622 bp, Homo sapiens
  misc_feature: GZ8MTXP02H14G5.11.57.F02.1.454.CMB.2.raw
  modified_base (204)..(204): a, c, t, g, unknown or other
  modified_base (260)..(260): a, c, t, g, unknown or other
  modified_base (267)..(267): a, c, t, g, unknown or other
  modified_base (377)..(377): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccggccaccctgtctgcgtctcctggggaaacngtcaccctctcctgcagggccagtacaaaatattaacaactacttagctgtccaanagaaccngcagctccagctctcatctatgatgctagtttaggagggccagtggaccactccccacccgtaggttcaggtcggctaggtgggtctaggggacagtacttcattctacnccagtccgacagtcctagactcctagaatagtttgcttaagtttacttacgttagtacaacgtagcgtagaccagaccgtacgggtcccgtcccgggacggtaccggttaccggaccgaaacggggtaacccgtaaaggggtacggaacgtaacgaacggtaccggtaaacgttcgggtacggaccgtacggaccaacctacgttcgttaacgtctttaccactttcccgtaccccgtctactcg

SEQ ID NO: 441844 - DNA, 517 bp, Homo sapiens
  misc_feature: GZ8MTXP02FIY8D.11.57.F02.1.454.CMB.2.raw
  modified_base (308)..(308): a, c, t, g, unknown or other
  modified_base (453)..(453): a, c, t, g, unknown or other
  modified_base (475)..(475): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggcccgggggggtccctgagactctcctgtctagtctctggattcgccttcagtgactatcgccatgaagtgggtccnccaggctccgagggtaaggggctgggaatgggtatttcatacattacgcagtagtggtgcgacatatactacgcagactctgtgaagggccattcatcatctcagagaacatggacaaacactcactgtatcgtagaaatcaacngacctgagacgtgaggacacgntgtactattagtgtgacgagaccgaccccgtaggtcgtacgg

SEQ ID NO: 441845 - DNA, 736 bp, Homo sapiens
  misc_feature: GZ8MTXP02JCE4U.11.57.F02.1.454.CMB.2.raw
  modified_base (294)..(294): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttccaacagaaacctggccaggctcccgaggctcctnatctatgatgctagtttaggagggtcccacgtggccacttcccccgacccgtaagggttcaggttcggcgtaggtcgggtctacggggacaggtaccttacgatttcctacaccctagtcccggaccacgggtaccccttaaggacgtcccgttaagtaaagtttacgtttttacgacgttaacgtttttaagtttaccgtacggttaactaaaacggacgtacggttaacgaccgtacggaccgtaccgggtccccgtacccgggtaccgggtaaccggttccgggaaccgtaaacgggggaacccgtaaaggggtacggaaaacgtcgaaaacggtacgtaaaccggttggtccggagttaccggaccaacccgttaagttaccgtcgttaccctttaccgtaccgtttccccgttaccccggtacctaacgttttcccg

SEQ ID NO: 441846 - DNA, 760 bp, Homo sapiens
  misc_feature: GZ8MTXP02IFWVW.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcatcctgctactctggctcccagataccaccggagaaattgtgttgacacagtctccggccaccctgtctgcgtctccgtgggaaacagtcaccctctcctgcaggccagtacaaaatattaaacaactacttagcctggttaccaacaagaacctggccaggctccaggctcctcatctatgatgctagtttagggacggccacgtggacactcccatccgtaggttcaggtggcgtaggtgggtctggggactaggtactttcgactttccgaccacctacgttcccgctacgaccttacggaacgtccgtaggtaaagttcgtttttacggactttaaggtttttaacttaacgttacgtaaccgtaaaccgtaggtaaccggttacgtaccgaacggtaccggtaaccgggtccccggttaccccggggtacccggtaaacccggggtttcccggggaacccggtaaaaccgggggtaacccggtaaagggggtaccgggtaaaacggttaaccgtaaaacgggacccgggttaaaacgttacgggttccgggtaaccgtccgggtaacccgtaccttaaccgttccgtttaacggttccctttaccgttaaccctttccccgtttaccccggtaacccg

SEQ ID NO: 441847 - DNA, 606 bp, Homo sapiens
  misc_feature: GZ8MTXP02GJBYH.11.57.F02.1.454.CMB.2.raw
  modified_base (204)..(204): a, c, t, g, unknown or other
  modified_base (380)..(380): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctggttaccaacagaaacctggccaggctcccaggctcctcatctatgatgcagtttaggagggccacgtggcactccccaccgtaggttcaggtggctaggtgggtctcgggacagtactcattccncaccactccgcacgcctagacgtccctagaagtacttttgacttagtttattactgtacaagtagcgtagcagcgacggtccgtcggacggtaccgtaccggacgaaacggggaacccgaagggtcggaaacgtacgaaacggacgtaaacgtcggtacggacgtcggacctaaccacgttccgtcgttccttaccgtacttcccgttacccgtctaacgtttccg

SEQ ID NO: 441848 - DNA, 634 bp, Homo sapiens
  misc_feature: GZ8MTXP02JH3QB.11.57.F02.1.454.CMB.2.raw
  modified_base (368)..(368): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccagtggcatcccacccagttcagtgcagtgggtctgggacagacttcattctcnccatcgcagcctagacgcctagaagtattttagctagtttattactcgtacaactacgacgtagcagcgaggtacccgtccgggacgtaccggtttccggacccgtaacggggaaccgaaacgggtcgggaaacgtacgaaaacggtaccggaaaaccgttgggtacgggtacgttacgggccctaaacccggtaacttaccgttaacggttcccgtttaccctaacggtttcccctttcccccggtacccttaacggtttacccg

SEQ ID NO: 441849 - DNA, 633 bp, Homo sapiens
  misc_feature: GZ8MTXP02FN8CO.11.57.F02.1.454.CMB.2.raw
  modified_base (204)..(204): a, c, t, g, unknown or other
  modified_base (212)..(212): a, c, t, g, unknown or other
  modified_base (261)..(261): a, c, t, g, unknown or other
  modified_base (287)..(287): a, c, t, g, unknown or other
  modified_base (344)..(344): a, c, t, g, unknown or other
  modified_base (361)..(361): a, c, t, g, unknown or other
  modified_base (363)..(363): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcacctntcctgcagggccagtcaaaatattaacaactacttagcctggttccaanagaaacctgccaggctccagctcctnatctatgatgcatttaggagggccactggcatcccaccagttcagtggcagtggtcngggacagtactcattcncnccatccgcagcctagacgcctgaacgtatttgctagtttattactgtacaacgagacgtagacgagacgacggtcctccgggacggaacgtttccgggaccgtaaacggggaccgaaacgggttcggaaaacggtccaaaacggtaccggtaaaaccgttgggtacgggtaccgttacggacccgtaaccctaacgtttacccgtcggtttacccgtttaaccgtaacctttccccggtttaaccccctcccgttaaacggtttaccccg

SEQ ID NO: 441850 - DNA, 564 bp, Homo sapiens
  misc_feature: GZ8MTXP02JQSC9.11.57.F02.1.454.CMB.2.raw
  modified_base (239)..(239): a, c, t, g, unknown or other
  modified_base (324)..(324): a, c, t, g, unknown or other
  modified_base (350)..(350): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgnggtctttgcttggcattatgccacctccacgccgtccacgtaccagttgaacttgacctcagggtcttcgtgctcacgtccaccnccacgcatgcgacctcgacgggtccnccaggctcccgagggtacggctaggatggtattcatacattagctaggtagtggtacgcgacatatactacgcagactcgtgtacgaagggtccgtattcatcactctaccagaatacaagtcggaactaacgaactacacgtatagtacgtaacgaaataccaaacgacgtaccgtaaggacgaacggtacggaacggacctacgggtctaag

SEQ ID NO: 441851 - DNA, 535 bp, Homo sapiens
  misc_feature: GZ8MTXP02JWR6Y.11.57.F02.1.454.CMB.2.raw
  modified_base (308)..(308): a, c, t, g, unknown or other
  modified_base (375)..(375): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcttagtccgaggcccggggggtcctgagactctcctgtctagtctctggattcgccttcagtgactatgccatgaagtgggtccnccgagctccgagggtaaggggctagggaatgggtatttcatactattacgcagttagtgtgccgacntatactacgcagactctgtagaagggcccgattcgatcatcctaccgaagtagaccaagtcggacaaacactcactgtatcagaaatcaacagctagagagtacgaggacacggtctagtatattagtgcgacgacgaccgaccccgtacggtacgtacg

SEQ ID NO: 441852 - DNA, 635 bp, Homo sapiens
  misc_feature: GZ8MTXP02J0OWW.11.57.F02.1.454.CMB.2.raw
  modified_base (264)..(264): a, c, t, g, unknown or other
  modified_base (359)..(359): a, c, t, g, unknown or other
  modified_base (381)..(381): a, c, t, g, unknown or other
  modified_base (398)..(398): a, c, t, g, unknown or other
  modified_base (408)..(408): a, c, t, g, unknown or other
  modified_base (431)..(431): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaaacaactacttagcctggttaccaanagaaacctggccaggctcccaggcctcctcatctatgatgctatttaggagggccacgtggcactcccacccgaggttcaggtggcagtgggtcnggggacagtcttcattcctacnccatccgcagcctagancctagaactntttgctagtttatactgacaacngtacgtagacagcgacggcccgttcccgggacggtaccgttacgggacccgtaaaggggaccccgtaaaggggttcggaaacggttacccgaaaggtacccgggtaaaatttcggggaaccggtccgttacgacccgtaacctaacgttccgttaacgttcctttaccaacgtttcccccgtttaccccgtaccctatttcccg

SEQ ID NO: 441853 - DNA, 640 bp, Homo sapiens
  misc_feature: GZ8MTXP02HF2SZ.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaaggtggtgcaggtcgtgggggagcttagtccgaggccggggggtccctgagcctctcctgtctagtctctggattcgccttcagtgactatgccatggaagtgggtccgcgaggcctccgaggtaacggggctagggaatggtatttcatacattacgctagtagtggtgaccgacagtactacctacgcagtactcgtaggtagaacgggtccgtattcatccattcctaccgaagtacgaacgaagtacggaaccaaacaacctctaacgttacgtaacttacgttaaggaaacttacgaaacgacgtaccgtaggaacggtaacggtaccggaaggtaacccgaccgggtacttacggttaacttaagtttagttaacggtaggtacccggtacggaccccggtacccccgtacggggttaccgtaaccccgggg

SEQ ID NO: 441854 - DNA, 567 bp, Homo sapiens
  misc_feature: GZ8MTXP02GPBHY.11.57.F02.1.454.CMB.2.raw
  modified_base (307)..(307): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgctattttagaaggtgtccagtgcgaggtgcaagtggtgcagtcgtgggggagcttagtccgaggccggggggtcctgagctctcctgtctagtctctggattcgccttcagtgactatcgccatgaagtggtccgccnggcctcgagggtaaggggctagggatggtatttcatactattagcgtagtagtggtgaccgactataactactacgcagactcgtgtagaagggcctatcatctatcctccaagacgacaagtcggaacaaacactctactacgtatacgtaaggaaactacgaaacacgacctagagtacgtcggagaccgacgggtacttagtaacttagttagtaagtcgacgtacgacccgtaccccggttacggacgtacccggg

SEQ ID NO: 441855 - DNA, 518 bp, Homo sapiens
  misc_feature: GZ8MTXP02G2KJH.11.57.F02.1.454.CMB.2.raw
  modified_base (378)..(378): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtcctgagactctcctgtctagtctctggattcgccttcagtgactatgccatgaagtcggtccgccaggctccgaggtaagggctggaatggatttcatacattacgcagtagtggtgcgacatatactacgcagactntgtagaggcgatcatcatctcagacgacaatggacaacaactcactagtatcgtagaactcaacacgcgtagagtacgtacgaggacgacggctagtactattatgtcgacgacgaccgaccccgtacggtacgtaccgg

SEQ ID NO: 441856 - DNA, 531 bp, Homo sapiens
  misc_feature: GZ8MTXP02GQKG4.11.57.F02.1.454.CMB.2.raw
  modified_base (351)..(351): a, c, t, g, unknown or other
  modified_base (434)..(434): a, c, t, g, unknown or other
  modified_base (461)..(461): a, c, t, g, unknown or other
  modified_base (498)..(498): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggtctttgtcttggctattatgcacctccacgccgtccacgtaccagttgaacttgacctcagggtcttcgtgctcacgtccaccaccacgcatgcacctcgacggggtccnccaggctccccgagggtaggggctagggaatggatttcatacattagctagtagtggtgacgaccatatactacgcagactcngtgaagggccattcatcatccacaganacaatgacaacatcactgtatcgtagaaactcaaacncgcctaagaacgacgtacggagacacggcttag

SEQ ID NO: 441857 - DNA, 770 bp, Homo sapiens
  misc_feature: GZ8MTXP02FTX6X.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacagtcaccctctcctgcagggccagtcaaaatattaacaactacttagcctggttccaacagaaacctggccaggctcccaggctcctcatctatgatgctagtttaggagggccacgtggcactccccaccaggttcaggttcggacgaggtgggtcgtcgggacagtacttctattccaccacctacgtcccgacgacgtcctaaggacgtccctagtaaagttacgttttagaccgttaaggtttttaacttacgttacggttaacctaaacgtacggtacgttaacggaccgaacggtaccgaaccggggtccccggttaccccggggtaccgggtaaacccggggtttaccccggggaaacccgggtaaaacgggggtaaacccgggtaaaagggggttaacggggaaaaccgggttaaccggaaaacggtaaccgggtaaaaccggttcgggttacggggaccgttacgggaccctaaacccgttaacgttacccgttcggtttacccgtttaaccttaacccgtttccccgtttacccccggaccttaccgtttacccgg

SEQ ID NO: 441858 - DNA, 740 bp, Homo sapiens
  misc_feature: GZ8MTXP02G8IWH.11.57.F02.1.454.CMB.2.raw
  modified_base (206)..(206): a, c, t, g, unknown or other
  modified_base (266)..(266): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcgaggccagtacaaatactaacaactacttacgccttgtaccaanacgaaccgtcggaccacggcctccgacggtcctcctcactctatgatcgtacttaggtttacggacggtcctacgtcggacctaccgtacccccgaaccgttacggtttacgaagggttcggacgtcggggttacgggtacgtaccggggactaacgtaccttacgtacttccacctaccgtaccgtcccgaccgtaccgtaccgtacgtacgtacccgttaagtaacgtttacgttttacgaccgtttaaagtttttaccttaacgtccggtaaactaacgtacgttacgtacgaccgtacggaccggtaccgggtacccgtccgggtaccggtacccggttaccgggaaccgaacggggtaaccgtaaggggtacgtaaacgacgaaacggtcgtaaacggtcggtacgtcgacgtaccctacgtacttccgtaacgttcctacgttaccttccccgccgtactacgtttcg

SEQ ID NO: 441859 - DNA, 598 bp, Homo sapiens
  misc_feature: GZ8MTXP02H47B9.11.57.F02.1.454.CMB.2.raw
  modified_base (462)..(462): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttcctgttgctattttagaggtgtccagtgcgaggtgcaagtggtgcaggtcgtgggggaggtcttaggtccgaggccgggggggtccctggacgactctcctgtctagtctctggattcgccttcagtgactatgccatgaagtcgggtccgcaggcctccgaggtaaggggctagggaatggtatttcatactattacgcgtagttaggtgggttcgacggtaaccctagttaactaacctaccggacagtacctccgtaggtaggaacgggccgtattcgaatcaacttcctaccagganactaatggacaaacaacttcacgtagtactacgtaggaaactcaaacacgccgtagacggtagtacggaggacacggtactacgtaagttattagttgtacgacggtacgaccgtacccccgttaggtcgtaccgg

SEQ ID NO: 441860 - DNA, 617 bp, Homo sapiens
  misc_feature: GZ8MTXP02HP11U.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaggtgtccagtgcgaggtgcaagtggtgcagtctgggggagcttagtccaggccggggggtccctgagactctcctgtctagtctctggatcgccttcagtgactatcgaccagtgaaggtcggggtcccgccgaggcctaccgaagggtaaacggggctagggaaatgggtatttcaagtactattagactagtagtggtcgacgaccatactacgtacgcaagtactcgtagtagaaacgggccgtattcagtcactcctcaagaacgacaagtacggacaaactaactcaacttggtaatacgtaaggaaactacaaacgacgtacctaggaaagtacggtacggaacgggaaccacgggtaccttagttaaactttaagtttaagtcggttgaacggttacgacccggtacccccgtaacgggttacgaacccgg

SEQ ID NO: 441861 - DNA, 567 bp, Homo sapiens
  misc_feature: GZ8MTXP02F86WI.11.57.F02.1.454.CMB.2.raw
  modified_base (370)..(370): a, c, t, g, unknown or other
  modified_base (379)..(379): a, c, t, g, unknown or other
  modified_base (391)..(391): a, c, t, g, unknown or other
  modified_base (424)..(424): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaaacaactacttagcctggttccaacagaaacctggccaggctcccaggctcctcatctatgatgctatttaggagggccatggcatcccaccagttcagtgcaggtggtctggggacagtacttcattctcnccatcccgntacgcctagacncctagagtatttgctagtttatactgtacaacngacgtagctagcacggcctccgggcgtaccggttccggaccgaagggaccgtaagggtcgaaacggtcaaacggacggtaacgtggtcggctacgaccaacctattcgtgttccttactacgttcccttaccgactacttacg

SEQ ID NO: 441862 - DNA, 543 bp, Homo sapiens
  misc_feature: GZ8MTXP02IQ5EU.11.57.F02.1.454.CMB.2.raw
  modified_base (408)..(408): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgcttattttagaaggtgtccagtgcgaggtgcaagtggtgcagtcgtgggggagcttagtccgaggccggggggtccctgagactctcctgtctagtctctggattcgccttcagtgactatgccatgagtggtccgcaggctccgaggtagggctgggaatggtatttcatacattagctagtagtggtgccgaactgtatactacgcagctctgtgaggcctatcatcatccacaganacatcgacaaacactcacttgtactcgagtaaactcaaacgagtcctagacgacgtacggaaggaccgacggtcttagttacttatttagtgtacggacgtacgacccgtacccccgttacggtacgtacccggg

SEQ ID NO: 441863 - DNA, 608 bp, Homo sapiens
  misc_feature: GZ8MTXP02F87HX.11.57.F02.1.454.CMB.2.raw
  modified_base (203)..(203): a, c, t, g, unknown or other
  modified_base (260)..(260): a, c, t, g, unknown or other
  modified_base (286)..(286): a, c, t, g, unknown or other
  modified_base (293)..(293): a, c, t, g, unknown or other
  modified_base (404)..(404): a, c, t, g, unknown or other
  modified_base (430)..(430): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacggagaaattgtgttgacacagtctccggccaccctgtctgcgtctcctggggaaacngtcaccctctcctgcagggccagtacaaaatataacaactacttagcctgttccaanagaaacctggcaggctccaggctccncatctangatgcagtttaggagggccacgtggcactccccacctaggttcaggtgcgaggtggtctgggacagtacttcacttctcaccactccgcacgcctagacgccgtagaagtntttagcttagtttattactgtacaangacgtagcagccgacgggtccgtccgggacggtacggttccgggaccgaaacggggaaccgaaaggggtacggaaacgtcgaaaacggcgtaaacgtggtcgggacctacggaccgtaaccctagtttcgtaacggtttccttactacccgttccttaccccggaccttagttacccg

SEQ ID NO: 441864 - DNA, 602 bp, Homo sapiens
  misc_feature: GZ8MTXP02JRXAK.11.57.F02.1.454.CMB.2.raw
  modified_base (357)..(357): a, c, t, g, unknown or other
  modified_base (363)..(363): a, c, t, g, unknown or other
  modified_base (378)..(378): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacagtcaccctctcctgcagggccagtcaaaatattaaacaactacttagcctggttccaaacagaaacctggaccaggctacccaggctcctcatctatgatgctatttaggaggccatggcatcccaccaggttcagtgcaggtggtctgggacngacttnattctcaccatccgnacgcctagacgcctagaaagtattttgacttaagttttattactagtacaaacagtacgtaagccgagaccgacgggcccgttacccgggacggtacccgttccgggaccgaaacgggggaaccgaagggtaggaaacggtacgaaaacgacgtaacgtggtacgcgacgaccctactactcgttccgttcctacttaccttacccgtccctacttaccgttcg

SEQ ID NO: 441865 - DNA, 629 bp, Homo sapiens
  misc_feature: GZ8MTXP02IKF2H.11.57.F02.1.454.CMB.2.raw
  modified_base (204)..(204): a, c, t, g, unknown or other
  modified_base (266)..(266): a, c, t, g, unknown or other
  modified_base (295)..(295): a, c, t, g, unknown or other
  modified_base (395)..(395): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaacttacttagcctggttaccaanagaaacctggccaggctcccaggctcctnatctatgatgctagtttaggagggccacgtggacctatccccacccgtaggtttccaggtcggctaggtcggctacggggacagtcttcgatttcctacnccgtatcccgacagtacccgtaagactccctagaaacgttacttttagacttaagttttaacttactgttacaaacgagtccgtaagcgacgcgaacggtcccgtcgggtaccgtaaccgttccgaccgaacggggtaaccaagggtagacgtacgaaacgcggaaacttcggacgaccgtgaccgtaccaagttcgtcgttacgttctacctccgttcccgacttacttaccg

SEQ ID NO: 441866 - DNA, 713 bp, Homo sapiens
  misc_feature: GZ8MTXP02H6Y9D.11.57.F02.1.454.CMB.2.raw
  modified_base (207)..(207): a, c, t, g, unknown or other
  modified_base (251)..(251): a, c, t, g, unknown or other
  modified_base (259)..(259): a, c, t, g, unknown or other
  modified_base (261)..(261): a, c, t, g, unknown or other
  modified_base (265)..(265): a, c, t, g, unknown or other
  modified_base (274)..(274): a, c, t, g, unknown or other
  modified_base (279)..(280): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcgacggcagtacaaatataacaactactnctgtacananaacncgcagctcngctcnntctatgatgactagtttacgggacggtccacgtcggcctacctccccgacccgtaggttccgaggtcggcgtaggggtcgggtcgtacggggacctacggtacctttacgtactttaccctaccacccgtaaaccgtccccgaccgtaaccgtaccccgtaggtaccgtacccgttaaaggtaaacggttatttttacgggaactttaaaggttttaactttaccgtagttaaccaacgtaggtacgagtacgacggtaccggaccggtcccggtacccggtaccggggtaccggttacccggggacgaaaccgggggtaacctaaagggggttagggaaacgtaaccggaaacggacggtaacggtgggtacggtaccgcgtaccacgttcttcggtcgtttacctactccgttcctacccgtgttaactcg

SEQ ID NO: 441867 - DNA, 616 bp, Homo sapiens
  misc_feature: GZ8MTXP02IZEJE.11.57.F02.1.454.CMB.2.raw
  modified_base (259)..(259): a, c, t, g, unknown or other
  modified_base (466)..(466): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcaggccagtacaaaatattaacaactacttagctgtaccaanagaacctggccaggctccagctctcatctatgatgctagtttaggacgggccacgtggaccactaccccaccccgtagggttccaaggttggactagggtcggggtcgtacggggacagtacttctatttcctcacctacgtcccgacacgcctaaggacgtcctagaagttatttgacttaagttttattacgttgtaacaaacgngtacgtagccgtaagccgaacggtcccgttaccggggcgtaaccggtccggaaccgaaaggggaaccgtaaagggtggaaacgtacgaacggacgtaacgtggtacgctcgacgaccagttctgtcttcgtactccctccgctacgttcg

SEQ ID NO: 441868 - DNA, 596 bp, Homo sapiens
  misc_feature: GZ8MTXP02G8ATM.11.57.F02.1.454.CMB.2.raw
  modified_base (287)..(287): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgcttattttagaaggtgtccagtgcgaggtgcaagtggtgcagtcgtgggggagtcttaggtccgagggcccgggggggtccctgacgactctcctgtctagtctctggattcgccttnagtgactatgccatgagtcgggtccgccgaggcctaccgaagggtaaggggctagggaatggtatttcatactattagctagtagtggtcgaccgaacagttactactacgactagtactcgtggtagaacgggaccgtattcatcactctcagaacgacacgtagacaaacactacactgtaatcgtaagtaaactacaaacacgaccgtagaacggtaacggtacggaacggaccggacgtacgttacgttaacttaagtttaagttcgtagacggtacgaccgtacccccgtacggtacgtaccgg

SEQ ID NO: 441869 - DNA, 615 bp, Homo sapiens
  misc_feature: GZ8MTXP02HCSY0.11.57.F02.1.454.CMB.2.raw
  modified_base (239)..(239): a, c, t, g, unknown or other
  modified_base (287)..(287): a, c, t, g, unknown or other
  modified_base (298)..(298): a, c, t, g, unknown or other
  modified_base (308)..(308): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgngtcttttgcttggcattatgcacctccacgccgtccacgtaccagttnaacttgacctnaggtcttcgngctcacgtccaccaccacgcatgtcgacctcgacggggtccaccgaggcctaccccgagggtaaggggctagggaatggtaacttttcaattacagtttagctaaggtagtggtgcgaacatactactacgcagactcgtagtacgaacgggacctatttaccattacaacttccgtaccaagaacgaacgtaaagtacggaacctaaacaaactacctaattacggttaataccgttaaaggaaaacttcgaaaaccgtagacccgtaagaaacggacggtacggaacggtacgacggtacttaag

SEQ ID NO: 441870 - DNA, 539 bp, Homo sapiens
  misc_feature: GZ8MTXP02FH9ZW.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtgcagtgggtctggggacagacttcattctcaccatcccgcagccctagacgcctagaagtattttgctagtttattactgtacaaactagacgtagcagcacggcctccggcgacgttccggaccgaagggacaagggtaggaagtaaagcgaaacgtggtgctgacaccagtctgtcttcactcttcccgctactcgtag

SEQ ID NO: 441871 - DNA, 534 bp, Homo sapiens
  misc_feature: GZ8MTXP02H14J5.11.57.F02.1.454.CMB.2.raw
  modified_base (239)..(239): a, c, t, g, unknown or other
  modified_base (311)..(311): a, c, t, g, unknown or other
  modified_base (354)..(354): a, c, t, g, unknown or other
  modified_base (438)..(438): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctccgnggtctttgtcttggctattatgcacctccacgccgtccacgtaccagttgaacttgacctcagggtcttcgngctcacgtccaccaccacgcatgtcgacctcgacggggtcccnccgaggcctcccgagggtaacggggctaggaatggatttcatacattagcagtagtggtgcgaccatatactacgcacgactcngtagaaggcctattccatcatctaccagagacaagtcgacaacaactcactgtaatctagaaactcaaacagctaagagacgcgagacacggctag

SEQ ID NO: 441872 - DNA, 536 bp, Homo sapiens
  misc_feature: GZ8MTXP02GIXHM.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccaggccggggggtcctgagactctcctgtctagtctctggattcgccttcagtgactatcgccatgaagtcgggtccgcgaggctccgagggtaaggggctaggaatggtatttcatacattagcagtagtggtgcgacatactactacgcagactcgtgtagaaggcctatcatcatctacagagacaagtgacaaacactacgactgtatctaggaaatcaaacacgacctagagacgtacggaggacgacggactagtacttagttagtgtacgacgtacggaccgtaccccgtaggtcgtaccg

SEQ ID NO: 441873 - DNA, 574 bp, Homo sapiens
  misc_feature: GZ8MTXP02GPXQ8.11.57.F02.1.454.CMB.2.raw
  modified_base (355)..(355): a, c, t, g, unknown or other
  modified_base (533)..(533): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggtctttgtcttggctattatgccacctccacgcccgtccacgtaccagttgaacttgacctcagggtctcgtgctcaccgtccaccaccacgcatgtcgacctcgacggggtccnccaggctcccgagggtagggctaggaatggattcatacagttagcagtaggtggtcgcgacctatactacgtacgcagtactcgtagtacgaacgggccgtaattcaattcaacttccgtaccaaggacaacaagtcggaccaacaactcactagtactcgtaaggaaactacgaacncgaccgtaagaacgagtaccggaaggaccacggtactttag

SEQ ID NO: 441874 - DNA, 632 bp, Homo sapiens
  misc_feature: GZ8MTXP02FMMBB.11.57.F02.1.454.CMB.2.raw
  modified_base (164)..(164): a, c, t, g, unknown or other
  modified_base (204)..(204): a, c, t, g, unknown or other
  modified_base (370)..(370): a, c, t, g, unknown or other
  modified_base (376)..(376): a, c, t, g, unknown or other
  modified_base (382)..(382): a, c, t, g, unknown or other
  modified_base (584)..(584): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttganacagtctccggccaccctgtctgcgtctcctggggaaacngtcaccctctcctgcagggccagtcaaaatattaacaactacttagcctgtccaacagaaacctggccaggctcccaggctctcatctatgatgcatttaggagggccactggcatccccaccaggttcagtggcaggtgggtctagggacagtacttcatttccncgaccnctccgnacgtcctagacgtcctagaaattcgtttagacttagttttatactcgttacaaacgtgacgtacgacgacgcgtaacgggtcccgtaccgggtaccggtaccgttacccgggaacccgaaagggggaacccgtaaaggggtacggaaacgtacgaaaacgggtaccgtaaacggttggtacgggacttacgaccgaaacctnttccgtaagttccttaacgcttccccgttcccggaactctttaaccgg

SEQ ID NO: 441875 - DNA, 569 bp, Homo sapiens
  misc_feature: GZ8MTXP02FWQOV.11.57.F02.1.454.CMB.2.raw
  modified_base (434)..(434): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtccctgagactctcctgtctagtctctggattcgccttcagtcgactatcgcctagtggaaggtggtccgccgaggcctaccgagggtaaggggctaggaatggtatttcaatacattacgcgtagtagtggtgaccgactatactacgtacgcagactcgtgtagaacgggtcctatcatcatcctacaganaacagtacgacaaacactcacttagtataccgtagaaactacaaacgacgactaggacgaggtacgaaggacgtacgtatacgttaatattagtgtacgacggtacgacccgtaccccgtacgggtcgtaaccgg

SEQ ID NO: 441876 - DNA, 645 bp, Homo sapiens
  misc_feature: GZ8MTXP02GFMBN.11.57.F02.1.454.CMB.2.raw
  modified_base (265)..(265): a, c, t, g, unknown or other
  modified_base (292)..(292): a, c, t, g, unknown or other
  modified_base (364)..(364): a, c, t, g, unknown or other
  modified_base (511)..(511): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctggggagggctttgttggagaccttgcacttgtactccttgccattcagccagtcctggtgcagggacggtgaggacgctgaccacgacggtacgtgctgttgtactgcctcctccgcggtcttttgtcttggctattangccacctccacgcccgtccacgtaccngttgaacttgacctcgagggtctcgtgctcacgtccaccaccacgctatcgtcgacctcggacggggtcccncgaggcctacccggaggggtaacggggctagggaatggtatttcaatactagttagctaggtagtcgggtacgaccgaactagtaactacctacgacagtactcgtggtacgaacgggcctattacgattcacttaccgacaagganacgtaagtacggaaccaaacgtaactctaacgttagttaacttacgtaaacggtaaaacttaccgaaaacgtcggttacccgtaaggaacggtaacggttaccgggaaaggtaccgtaacgggtactttaaagg

SEQ ID NO: 441877 - DNA, 775 bp, Homo sapiens
  misc_feature: GZ8MTXP02I1SI0.11.57.F02.1.454.CMB.2.raw
  modified_base (204)..(204): a, c, t, g, unknown or other
  modified_base (262)..(262): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcaccctctcctgcagggccagtcaaaatattaacaactacttagcctggttccaanagaaacctgcaggctccagctcctcatctatgatgctagtttaggagggccacgtcggacactccccacccgtaggtttcaaggtcggacctaggtcgggttctacggggaccaggtacctttcaacgtttcctaccaccgtaacttccccggactaacgcccgttaaggacgtcccttagtaaacgttatttttacggaccgtttaaggtttttaaacttacgttacggttacctaaacgtacggacgttacgacgtaaacggtccgaacgggtcccgtaccccggggtcggtaaacccgggtttcccgggaacccggtaaacgggggtaaacccgtaaacgggggttcggtaaaacgggttaccgaaaacgggtccggtaaaaccggtttgggtaccgggggttccgtaacggggtaccccgtaaaacccttcgtttaacccggttcggttttacccctttacgtaaaccctttccccggttttcccccggaccttaaaccgttttaccgg

SEQ ID NO: 441878 - DNA, 708 bp, Homo sapiens
  misc_feature: GZ8MTXP02JPT7N.11.57.F02.1.454.CMB.2.raw
  modified_base (206)..(206): a, c, t, g, unknown or other
  modified_base (294)..(294): a, c, t, g, unknown or other
  modified_base (413)..(413): a, c, t, g, unknown or other
  modified_base (666)..(666): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccaccctctcctgcagggccagtacaaaatataacaactacttagcctggtaccaacagaaacctgccaggcctcccgagctcctnatctatgatgactaagtttacgggacgggacctaacgtgggaccaacgttcccccgaacccgtaagggtttccaaggttcggactaaggtgttcgacccgtggggaaccaggtaccttnacttcctcaacctaatcccggacaagtcccgtaagtacggtacctagtaaacgttattttcggacttaagttttaactactagttaaccaaagtagaccgttaagcaaggcgaacggtcccgtacccgggacgttaaccggttccgggaaccgtaaacggggaaccgttaaaggggtagggaaaactaccggaaaaggtacggtaaaaccggtggttaccgggacttaccggaaccaacccagtttaacccgnggtttaacccctttacgaccctttacccgtcccgtactaacg

SEQ ID NO: 441879 - DNA, 612 bp, Homo sapiens
  misc_feature: GZ8MTXP02GMD57.11.57.F02.1.454.CMB.2.raw
  modified_base (264)..(264): a, c, t, g, unknown or other
  modified_base (285)..(285): a, c, t, g, unknown or other
  modified_base (381)..(381): a, c, t, g, unknown or other
  modified_base (571)..(571): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccacggagaaattgtgttgacacagtctccggccaccctgtctgcgtctcctaggggaaacagtccaccctctcctgcagggccagtacaaaatattaaacaactacttagcctggtccaanagaacctgcagctccagctcncatctatgatgactagtttaggacggccacgtggccactccccaccagttcagtggcaggtgggtctgggacagtacttcacttcacaccatccgnacgtcctagacgcctagaaagttatttgcttagtttattactgttacaacgagtacgtagacgacgacgacgcccgtaccgggccggtaaccggttacccgggaccgaaacggggaaccgaaacggggtggtaaacgtacggaaacggacggtaaaacgtggtacgggctacggaccacctacttccgtnttacccgttactacccgttccgttaccccgacctacttccg

SEQ ID NO: 441880 - DNA, 591 bp, Homo sapiens
  misc_feature: GZ8MTXP02GJMHR.11.57.F02.1.454.CMB.2.raw
  modified_base (318)..(318): a, c, t, g, unknown or other
  modified_base (365)..(365): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttggttggagaccttgcacttgtactccttgccattcagccagtcctggtgcaggacggtgaggacgctgaccacacggtacgtgctgttgtactgcctcctcccgcggtctttgtcttggctattatgccacctccaccgccgtccacgtaccagttgaacttgaccctcagggttcttcgnggcctcacgtcccaccaccacgcatgtcgaccctcggacggggtccnccgaggcctccgaggggtagggctaggaatggatttcatacattagctagtagtggtagcgacctataatactacgcagacctcgtggtacggaacgggcctatttacactcaactccgtaccaagagacctaagtcggaaccaaacgactcaacgttagttaactccgtaagaaactaccgaacacgtccgtaagacgtacggacgaaggacctacggtacttag

SEQ ID NO: 441881 - DNA, 714 bp, Homo sapiens
  misc_feature: GZ8MTXP02H8DP4.11.57.F02.1.454.CMB.2.raw
  modified_base (207)..(207): a, c, t, g, unknown or other
  modified_base (315)..(315): a, c, t, g, unknown or other
  modified_base (668)..(668): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctccgtaggggaaacngtccacccttctcctgcgagggccagtacaaaatattaacaacttacgttagcctaggttaccaaacacgtaaaccgtggacccgacggcctaccgacggcctccctnattctatgaatgtactatttagggacgggccacgtcggaccactaccccaccgtcggttccgaggtcggactagggtcgggtcgtacggacgtagtacctttcgtacttccgtacaccgtacgttcccgacgtaccggacctacggaacgtcccgtaagtaaagtttacgtttttacgaacgttttaacgttttaaacgttttaccgtacgtttaacaaacggttacggaccggttagacgtaccgtaccggaacggggttccccgtacccgggtaccgggtaccggttaccggaccgtaaaggggtaccgaaagggtacggaacgtaacgaacgacgtacgttggacgtacncgtaccacttcgtcgtcgttctacgtcttcccgtccgactacgtcg

SEQ ID NO: 441882 - DNA, 716 bp, Homo sapiens
  misc_feature: GZ8MTXP02JDL7L.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagatacaaccggagaaattgtgttgacacagtctccggccaccctgtctgcgtctcctggggaaacagtccaccctctcctgcagggccagtacaaaatattaacaactacttagcctggttaccaacagaaacctggcccaggcctcccgaggctcctcatctatgatgactagtttaggacggccacgtggacctacgtccccaaccgtacggttacgaggtcggctaggtcggggtactacggggactagtaccgttctaagtttcccaccgtaccgtacgttcccgacgtacgtacccgttaagaccggtcccgttaaggtaaacggtttattttacgacgtttaaggttttaactttacgtacgttaacaaacgtcggtacgttacgacgtaacgccggtacggtcccgtaccgggtaccgggtaccggttccgggaaccgggtaaccggggaacggttaacggggtacggtaaccgtaacggaaccggtacggtaacgtggggtacgacgtcggacctaaccgtgttccgtaacggtttcctacgttccgttccgtacccgccgtaattccgg

SEQ ID NO: 441883 - DNA, 588 bp, Homo sapiens
  misc_feature: GZ8MTXP02HEV7P.11.57.F02.1.454.CMB.2.raw
  modified_base (313)..(313): a, c, t, g, unknown or other
  modified_base (355)..(355): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgcggtctttgtcttggctattatgccacctccacgcccgtccacgtaccagttgaactgacctcagggtcttcgngctcacgtcccaccaccacgcatgtcacctcgacggggtccncgaggctccccgagggtaaggggctaggaatggtatttcatacattagctagtagtggtagcgacctaatactactacgacagtacttcgtaggtaggaacggggtccgtatttccaacgttcactctacccgaagaacgtaacaaagtacggaaccaaacgaactcctaacgtacgttatacgtagaaactcgaaacagactgaacgtacggacggagacgacggtactaag

SEQ ID NO: 441884 - DNA, 525 bp, Homo sapiens
  misc_feature: GZ8MTXP02J0RUJ.11.57.F02.1.454.CMB.2.raw
  modified_base (308)..(308): a, c, t, g, unknown or other
  modified_base (419)..(419): a, c, t, g, unknown or other
  modified_base (445)..(445): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaggtgtccagtgcgaggtgcaagtggtgcagtctgggggagcttagtccaggccggggggtccctgagctctcctgtctagtctctggattcgccttcagtgactatgccatgaagtggtccgccaggcnccgaggtagggctggatggatttcgatacattagcagtagtggtgcgaccatatactacgcagactctgtgaaggccgattcatcatctccagagacaagtgacaaacacncactacgtatctaggaaatcaaacgngcctagagacgtacggacggacgacgtcgtagtacttattagttgtcgacgacgacccgtaccccgtacggtacgtaccg

SEQ ID NO: 441885 - DNA, 705 bp, Homo sapiens
  misc_feature: GZ8MTXP02FNCYG.11.57.F02.1.454.CMB.2.raw
  modified_base (420)..(420): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacagtccaccctctcctgcagggccagtacaaaatattaacaacttacttagccttgttaccaaacagaaacctggaccaggcctcccgaggtcctcctcatctatgatgtactagtttaggacgggacctacgtggacctacctccccgaacccgtagggtacaggtcggacctaggggtcgggtacgtacgggacacgtacttcgtattcctacnccactccgacaccgaccgtagacgtccgtagtaagttatttgacttagtttacttacgtcgtaactaacgtagtacgtacgacgtacgaccgacggtacccgccggtaccgggtaaccgttacccgggacccggaaagggggacccgtaaaggggtacggaaaacggtacgaaaacgggtaccgtaaagttcgggtacggtacgtaccgtaaccggtacctagttaccgttaacggttccttaccgtaccctttcccgttacccccggtacttacgtttacccgg

SEQ ID NO: 441886 - DNA, 709 bp, Homo sapiens
  misc_feature: GZ8MTXP02G0WKO.11.57.F02.1.454.CMB.2.raw
  modified_base (259)..(259): a, c, t, g, unknown or other
  modified_base (271)..(271): a, c, t, g, unknown or other
  modified_base (279)..(279): a, c, t, g, unknown or other
  modified_base (299)..(299): a, c, t, g, unknown or other
  modified_base (303)..(303): a, c, t, g, unknown or other
  modified_base (308)..(308): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacagtcaccctctcctgcagggccagtacaaatataacaactacttagctgtccaanagaactgcagcnccagctcnatctatgatgctagttaggnggcngtgcnctcccacgtggttcaggtcgacgtaggtcgggtcgtcggggactagtaccttacgtactttcctacaccctaacgtcccggacacggtacccgttaaggacggtacccgtaaggtaaagtttacgtttttcggaaccgtttaaggtttttaactttaacgttacggtttaccaaaacggtaggtaacggttacgacccgaggtaaccaccggggtccgtacccggggtacgggtaccggttacccgggacggaaaacgggggttaaccggaaagggtacgggtaaacgtaccggaaaacggtacggtaaccgggttggtcggggtacctacggaacccgtaaccttcgttcggttcgtttccttaacgtcctttccccggtacccgtcctaactttccggg

SEQ ID NO: 441887 - DNA, 687 bp, Homo sapiens
  misc_feature: GZ8MTXP02I7MKT.11.57.F02.1.454.CMB.2.raw
  modified_base (205)..(205): a, c, t, g, unknown or other
  modified_base (265)..(265): a, c, t, g, unknown or other
  modified_base (288)..(288): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacggagaaattgtgttgacacagtctccggccaccctgtctgcgtctccgtaggggaaacngtccaccctctcctgcgagggccagtacaaaatataacaactacttagcctgttaccaanagaacctgcaggctccagctccncatctatgatgactagtttaggacggtccacgtggaccacctaccccacccgtaggttcaggtcggacgtaggtcggggtcgtacggggactagtactttactacttccaccaccgtacgtcccgacgtacgtaccgtagacgtcccgtaagtaaagttatttacgtacgttaagtttttactagttacgtactaaacgtacgtacgtactacgacgacgtaccgggtccgtaccgggacggtaccggttaccggaccggaaacggggaccgtaaaggggtacgtaaacggtacgaaacggtaccggaaggttacggtcgggtaccgttcgacccgaaacgttcttacgttaacgttcgttaccttacccgttacccgttccccgtactaacgtttcgg

SEQ ID NO: 441888 - DNA, 555 bp, Homo sapiens
  misc_feature: GZ8MTXP02H064F.11.57.F02.1.454.CMB.2.raw
  modified_base (183)..(183): a, c, t, g, unknown or other
  modified_base (310)..(310): a, c, t, g, unknown or other
tcagcgagagataccacgaccggtgctcgatttagctcgatatagttggggtttgggggctctcagagaggtgccttggtcctggattccaaggcatttccacttggtgatcagcactgaacacagaggactcaccatggagttggggctgtgctgggttttcctgttgctattttagaggtntccagtgcgaggtgcaagtggtgcagtcgtgggggagcttagtcccgaggccggggggtccctgagactctcctgtctagtctctggattcgccttcagtgactatcgccatggaagtcggggtccnccaggctcccgagggtaaggggctaggaatggatttcatacattagcagtagtgtgccgaccatatactacgcagactctgtagagggcccgtatcatcatctccagagacaagtgacaaacactcactgtatcctaggaaatcaaacagccgtagaggtacgtacggaaggtacgaacggtcttacgtaatttaagtttagtgttcggacgacggaccgtacccccgttacggtcggaacccgg

SEQ ID NO: 441889 - DNA, 614 bp, Homo sapiens
  misc_feature: GZ8MTXP02JVIN5.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcagtcgtgggggagcttaggtccgagggcccggggggtccctggacgactctcctgtctagtctcgtggtcttccgccttcagtcgactatcgcctagtaggaaggtcgggtccgccgaggcctaccggagggtaaggggctaggaagtggtactttcatactagttacgactagtagtggtcgaccgactatactactacgacagtactcgtaggtacgacgggtacctagttcatctatcctacgaagaacacgaagtacgaccaaacacctctaacgttagtaactacgtaagaaactacaacacgtactagacgtacggacggaaggaccgtacggtcttagtaatttacgttagtaacgtgaccggacgtacccgtacccccggtaggtacggtacccgg

SEQ ID NO: 441890 - DNA, 692 bp, Homo sapiens
  misc_feature: GZ8MTXP02F5FMY.11.57.F02.1.454.CMB.2.raw
  modified_base (202)..(202): a, c, t, g, unknown or other
  modified_base (214)..(214): a, c, t, g, unknown or other
  modified_base (258)..(258): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctgggaaacngtcacctctccngcaggccagtacaaaatattaacaactacttagcctgttccaanagaaacctggccaggctccgagctcctcatctatgatgactagtttaggagggccaacgtggaccactccccaaccgtaggttcaggtcggacaggtgggtctggggaacacgtacttcagttcctaccacctaactcccgacacgtcctaagacgtacctagtaaacgttagttttacgacttaagttttaatttaccgtacgttaacaaacgtacggtacgtagacaacggccgaacggtcccgttacccgggaccgggtaaccggttacccggaaccggaaacggggtaacccgtaaaggggtacgggtaaaacgtacgaaacggtaccggtaaacgttacgggtacggtaccgttacggacccgaaccgtactaccgttaacggtcctttaccgtaaccttccccgttaccccgtacctacgtttaaccg

SEQ ID NO: 441891 - DNA, 540 bp, Homo sapiens
  misc_feature: GZ8MTXP02I89RX.11.57.F02.1.454.CMB.2.raw
  modified_base (303)..(303): a, c, t, g, unknown or other
  modified_base (309)..(309): a, c, t, g, unknown or other
  modified_base (353)..(353): a, c, t, g, unknown or other
  modified_base (369)..(369): a, c, t, g, unknown or other
  modified_base (398)..(398): a, c, t, g, unknown or other
  modified_base (412)..(412): a, c, t, g, unknown or other
  modified_base (452)..(452): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctatttagaaggtgtccagtgcgaggtgcaagtggtgcagtcgtgggggaggcttagtccaggccggggggtccctgagactctcctgtctagtctctggattcgccttcagtgactatgccatgaagtggccncaggcncaggtaagggctaggaatggattcatacattagcagtagtggtncgacatataactacgnagactctgtagaaacgggcctaattcatntactctccaagaanaacaagtacgacaaacaactacactatatacgtaagaaanaacaacagactagagacgacggacggacgacgtactagtaattaattagttaagtggacggacgtaccgacccgtaccggtacgtacg

SEQ ID NO: 441892 - DNA, 561 bp, Homo sapiens
  misc_feature: GZ8MTXP02HX75H.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttcttgttgctattttagaaggtgtccaatgcgaggtgcaagtggtgcagtcgtggggggaggcttaggtccgaggccgggggggtcctgagactctcctgtctagtctctggactcgccttcagtgactatgccataggaagtcggggtccgcgaggctccgagggtaaggggctagggaatggtatttcaagtacattacggactaaggttaggtggtcgaccgaccattaactaacgtacgcaagtactcgtgtagaacggcccgtattcatcatctcaagacacaatggacaaacactcactgtatcaggaaatcaaatagccgtagagtagacggagactaacggctagtaacttattagttcgagacgacgtaccgtcccccgtacgtacggaccg

SEQ ID NO: 441893 - DNA, 794 bp, Homo sapiens
  misc_feature: GZ8MTXP02H0HS3.11.57.F02.1.454.CMB.2.raw
  modified_base (205)..(205): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaaacaactacttagccttggttaccaacagaaacctggccaggctcccaggctcctcatctatgatgctagtttaggacgggccacgtcggccaactcccccgaaccccgtagggttcaggtcgggccaggggttcggggtcgttcggggaacctaggtacctttcgtaatttcccttcccaccacgttcccccgacgaccgtcccgtaaggaaccgtcccgttaaaggtaaagtagtttttaccgaacgtttaaggtttttaatttaccttacgggttaaccaaacgtaaacggtacggttaacgtaccgaacgggtacccggtaacgggtcccccggttaaccccggggtcccggggttaacccgggtttacccgggggaacccgggaaaacgggggtaacccgtaaaacgggggttaggaaaacgggttacggaaaacgggtaccggaaaacgttcgggtacggggacgtaacggaccctacccgtaacgttccgtaaggtttacccctttacgttaccgtttcccgttacccccgtccgtaacgtttccg

SEQ ID NO: 441894 - DNA, 636 bp, Homo sapiens
  misc_feature: GZ8MTXP02F12XJ.11.57.F02.1.454.CMB.2.raw
  modified_base (242)..(242): a, c, t, g, unknown or other
  modified_base (359)..(359): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctggggagggctttgttggagaccttgcacttgtactccttgccattcagccagtcctggtgcaggacggtgaggacgctgaccacacggtacgtgctgttgtactgcctccgtcccgnggtctttgtcttggctattatgccacctccacgcccgtccacgtaccagttgacttgacctcgaggtctcggtgcctcacgtccaccaccacgcatgtcgacctcgacggggtcccncgacggctaccccggaggggtaacggggctaggtaagtggtactttcgactactattacgctagggtacggtggtacgacgaacctaagtactacgtacgacaacgtacctgtagtaggaacgggtccgtaacttctatacctacttacctaccgaagtacgaacaacgtacggaccaaaacctaacctctaacgttgtactacgtaacggtaaactaccaaaacgtacgtacgtaaggaacgtaacggtacggaacggtacgaacggtcgtttaag

SEQ ID NO: 441895 - DNA, 572 bp, Homo sapiens
  misc_feature: GZ8MTXP02F4YK9.11.57.F02.1.454.CMB.2.raw
  modified_base (337)..(337): a, c, t, g, unknown or other
  modified_base (362)..(362): a, c, t, g, unknown or other
  modified_base (370)..(370): a, c, t, g, unknown or other
  modified_base (379)..(379): a, c, t, g, unknown or other
  modified_base (400)..(400): a, c, t, g, unknown or other
  modified_base (463)..(463): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtcctgagactctcctgtctagtctctggattcgccttcagtgactatgccatgaagtggtccgccaggctccgaggtaggggctggaatggatttnatacattagcagtagtggtgcgacntatactcncagactcgngtagaagggcccgtattacgnttacatcctccgaagagaaaccatcggacaaacactacactgtaatccaggaaactcaaacgngacctagagtacggtacggaaggtacaacgggtcttaggttaaacttaagttttatggttacggcgaaacggtacccggtccccccgttaaagggtcgttaacccgggg

SEQ ID NO: 441896 - DNA, 670 bp, Homo sapiens
  misc_feature: GZ8MTXP02HO61T.11.57.F02.1.454.CMB.2.raw
  modified_base (284)..(284): a, c, t, g, unknown or other
  modified_base (375)..(375): a, c, t, g, unknown or other
  modified_base (385)..(385): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctaggggaaacagtcaccctctcctgcagggccagtacaaaatataacaactacttagcctggtacaacagaactgcaggctccagctctnatctatgatgctagtttaggagggtccacgtggacactccccaacccgtaggttccaagtggcaggtgggtctggggacagtctcatttcncacactccanacgtccctagacgtccagtaagtattttgacgttagttttaattactaggtttacaaacgtgtacgttaagacgtaaacgcgtaacggtccgtacccgggacggtaacccggttcccgggaaaccggtaaaccgggaaccggtaagggtaacgggtaacgtaaacggaaacgtacggtaaaacccgttggtaacggggttcctacggaacccgacctaaccgtttacgttcggttacctttaccgtaaccgtttaccccttccccggtacccgttaaaccttcgg

SEQ ID NO: 441897 - DNA, 686 bp, Homo sapiens
  misc_feature: GZ8MTXP02GB2SZ.11.57.F02.1.454.CMB.2.raw
  modified_base (385)..(385): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctgccaggcctccaggctcctcatctatgatgctagtttaggaggccacgtggccactccccgaccgtaggttcaggtcggctaggtggggtctcggggacagtacttcgattcccncacccatcccgacacgcctagacgtccgtagaagttatttcgacttaagttttataacttcggtacaacgtacgtacgtacgacgtacgccgtaacggtccccgtaccgggtccggtaaccggttcccggggaaccgtaaccggggtaacccggtaaaggggtacggaaacggttacgaaaacggtacggtaaaccggttgggtaccgggtaccgttacggaccctaaccgtaacgttccgtaacggtttacccgttaaccttaccgttaccccgttcccccgtacctaacgtttacccgg

SEQ ID NO: 441898 - DNA, 552 bp, Homo sapiens
  misc_feature: GZ8MTXP02HJFN5.11.57.F02.1.454.CMB.2.raw
  modified_base (395)..(395): a, c, t, g, unknown or other
  modified_base (429)..(429): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgcttattttagaaggtgtccagtgcgaggtgcaagtggtgcagtcgtgggggagcttagccgaggccggggggtccctgagactctcctgtctagtctctggattcgccttcagtgactatgccatgaagtcgggtccgccgaggcctaccgagggtaaggggctagggaatggtatttacatacattagacagtgtggtgcgaccagtactacgtacgcagacctntggtagaaacgggcccgtatcatcatcctcaganacaatacggacaaacactcatagtatacgtaggaaactcaaacgataccgtagaacgacgtacggagtaccgaggtctagttattattagttgcgtacgacgccgtccccgtaggtcgaccgg

SEQ ID NO: 441899 - DNA, 531 bp, Homo sapiens
  misc_feature: GZ8MTXP02FLVP0.11.57.F02.1.454.CMB.2.raw
  modified_base (305)..(305): a, c, t, g, unknown or other
  modified_base (336)..(336): a, c, t, g, unknown or other
  modified_base (341)..(341): a, c, t, g, unknown or other
  modified_base (364)..(364): a, c, t, g, unknown or other
  modified_base (411)..(411): a, c, t, g, unknown or other
  modified_base (452)..(452): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtcctgagactctcctgtctagtctctggattcgccttcagtgactatcgccatgaagtggtccnccaggctcgaggtagggctggaatggtattnatacnttagcagtagtggtgcgacatanactacgcagtactcgtgtaggaacggccgtattcatcatctacaganacaatcggacaaacactcactgtatcgtagaaactcaaacngactagacgacgcgagacgacggtcttagtaactatttagtgtcgacggtacgaccgtaccccggtacggttcgaccgg

SEQ ID NO: 441900 - DNA, 658 bp, Homo sapiens
  misc_feature: GZ8MTXP02I09WZ.11.57.F02.1.454.CMB.2.raw
  modified_base (312)..(312): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggccggggggtccctgagactctcctgtctagtctctggtattcgccttcagtgactatcgccatgaaggtcgggtcccnccgaggctccgagggtaacggggctagggaatggtattacatactagtacgagtagtgtgcgaccaatataactacgtacgacaagtctcgtggtaacgggacggtaccttatacgacttcgtacctaccgtacgaaaggacgaaacgaacgtaccgaaaccaaaaccttacctacttaacggttattaacgtaaccggtaaacgtaaactaccgaaacgtaccgaccgttaagaacggtaacgggtacggaacggtaacccggtaggttacgttaacgttaacttaagtttaaggttggacgtaacggaccgtaccccggtacccggtacggtacgtaacccggg

SEQ ID NO: 441901 - DNA, 729 bp, Homo sapiens
  misc_feature: GZ8MTXP02IOEVK.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactgctcccagataccaccggagaaattgtgttgacacagtctccggccaccctgtctgcgtctcctggggaaacagtccaccctctcctgcagggccagtacaaaatattaaacaactacttagcctggttaccaacagaaacctgccaggcctcccgagctcctcatctatgatgactagtttagggacggggtcccacgtcggacactcccccgacccgtacgggtttcaaggtcggccgtagggtggggtcgttacggggacctaacggtacctttacactttccctaccacccgtacttaccccggcctaaccgtcccgttagaacgtcccgtagtaaacgttagtttttacgactttaagtttttaactttaacgttcggttaaccaaacgtacggtacgtaacgacctaacggaccgtacgggtaccccgtcccgggtacgggtaaccccggttacgggaacccgaaacggggtaaccggaagggtacggtaaacgtacgaacggtacgtaaacggtggtacgtacgtaccggaccaccttagttccttaaggttcctttaccgtaccgttcccttacccgtcctactttaccgg

SEQ ID NO: 441902 - DNA, 691 bp, Homo sapiens
  misc_feature: GZ8MTXP02JEBGG.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaatataacaactacttagcctggttccaacagaaacctgccagctccaggcctcctcatctatgatgctagtttaggacgggcacgtggcactaccccacccgtaggttccaggtcggcgtacggtgggtcgtcggggacacgtactcgtacttccgtcacctacgcccgtacgtaccgaccttaacggacgtacccgtaagtaagttacgtttttacgaccgtttaagttttactttacctcgttaacctaacgacggtacgttacgaccggaagtccggaaccggtcccgtaccgggacccgttaccggtcccggaccggtaaacggggaccggaacgggtagaacggtacgaacggtacgtacgtacggtcggtaccgtacggacccaccggttacttaccgttaacggtcgtttaaccgtaccttacccggttcccgtacccgttactttacccgg

SEQ ID NO: 441903 - DNA, 741 bp, Homo sapiens
  misc_feature: GZ8MTXP02ICYR3.11.57.F02.1.454.CMB.2.raw
  modified_base (166)..(166): a, c, t, g, unknown or other
  modified_base (206)..(206): a, c, t, g, unknown or other
  modified_base (260)..(260): a, c, t, g, unknown or other
  modified_base (266)..(266): a, c, t, g, unknown or other
  modified_base (280)..(280): a, c, t, g, unknown or other
  modified_base (286)..(286): a, c, t, g, unknown or other
  modified_base (307)..(307): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacanagtctccggccaccctgtctgcgtctccgtaggggaaacngtccaccctctcctgcgaggcagtacaaaattataacaactatagctgtacaanagaacngcagctccagctcnatctangatgctagttaggacggcagngacactcccacgtggttcaggtcggacgagggtcgggtacgtaggggaactacgtacttacgtactttcctacacctacgtccgacacgtcctaagactcgtaagtaaacgttgtttacgacgtttaagttttaaccgttacgtagtaacgaaaacgtacggggtcgttaaacgaccgtacggacccggtaaccggggtttcccccgggtacccggggtacccgggtaacccggggtttaacccggggaaacccggaaaaccgggggtaaacccggtaaagggggttaaacgggaaacccggttaacgggaaaacggtaccccgggttaaaaggtttcggggtaaccggacccgttacggaaccctaaccgtaacgttttaccgtcgtttacccttacgtacccgttccccgttaccccggactttaacgtcgg

SEQ ID NO: 441904 - DNA, 770 bp, Homo sapiens
  misc_feature: GZ8MTXP02HTVNL.11.57.F02.1.454.CMB.2.raw
  modified_base (205)..(205): a, c, t, g, unknown or other
  modified_base (263)..(263): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtcaccctctcctgcaggccagtacaaaatataacaactacttagcctggttaccaanagaaacctggccaggcctccaggctcctcatctatgatgctaagtttaggacgggcctacgtggcctaactccccgaccgtaggtttcaggtcggctagggtgggtcgtacggggactacgtacttctatttccactacctacttcccgactaccgtaccgtaaggacgtacccgttaagtaaacgtttacgtttttcgaaccgtttaaggtttttaactttaccgttacggttaaccaaaacggtaacggttaccggtaaacggtaccgaaccggtaccggtaaaccggggttccccgtaccccgggggttacccgggttaacccggggtttaccggggaaccccggtaaaacgggggaacccgtaaagggggtaaccggtaaaggtaaccgaaaacgggaccggttaaaaccggtgggtaccggacgttacggacctaaacccgttgttacgttcgttaccgtttaacctacgttccccgtttaccccggactttacgtttccgg

SEQ ID NO: 441905 - DNA, 703 bp, Homo sapiens
  misc_feature: GZ8MTXP02GQ7B5.11.57.F02.1.454.CMB.2.raw
  modified_base (206)..(206): a, c, t, g, unknown or other
  modified_base (291)..(291): a, c, t, g, unknown or other
  modified_base (295)..(295): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccaccctctcctgcagggccagtacaaaatattaaacaactacttagcctggtaccaacagaacctggaccagctcccaggcncctnatctatgatgctagtttaggacggccagtggacactccccgaccagttcaggtggcaggtcgggtcgtggggaacagtacttcacttacctccgaccactcccgacgtacgcccgtaagacgtcctaaaggtaactttaagttttcgacgtttaagttttaacgtttacgtacggttaaccaaaccggtaggaccggttaacgaccgaacggtaccggaacccgggtccccgttaccccggggaccggtaacccgggttacccggaacccggaaaacgggggtaacccgtaaagggggtaacggaaacccgtagaaaaccggtaccggtaaacgttgggaccgggtactacggacctaccgtactcgttaacgttccttactactcccgttcccgaccctagttaccg

SEQ ID NO: 441906 - DNA, 592 bp, Homo sapiens
  misc_feature: GZ8MTXP02GKBUF.11.57.F02.1.454.CMB.2.raw
  modified_base (208)..(208): a, c, t, g, unknown or other
  modified_base (260)..(260): a, c, t, g, unknown or other
  modified_base (555)..(555): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccanacggtactgctgttgtactgcctccgtccggcgtctttgtcttggctattancgccaccctccacgcccgtccacgtaccagttacgaacttcgacctcgaggtctcgtcgctcaccgtcccaccaccacgcagtgtcgaccctgacggggtcccacgaggcctaccccgaggggtaacggggctagggaattcggtaatttcgaactaactagttagacgtagtagtcgggtgaccgactatatactacgacacgactcgtagtaggaacgggccgtattcatcattaccacagacgacaagtcgactaacactctactagtactacgtaacgaaactacaaacgngtaccgaagacgacgtaccgagaacgcgacgtttaag

SEQ ID NO: 441907 - DNA, 625 bp, Homo sapiens
  misc_feature: GZ8MTXP02IZ99W.11.57.F02.1.454.CMB.2.raw
  modified_base (204)..(204): a, c, t, g, unknown or other
  modified_base (364)..(364): a, c, t, g, unknown or other
  modified_base (377)..(377): a, c, t, g, unknown or other
  modified_base (381)..(381): a, c, t, g, unknown or other
  modified_base (395)..(395): a, c, t, g, unknown or other
  modified_base (427)..(427): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacngtcacctctcctgcagggcagtcaaaatataacaactacttagcctgtccaacagaaacctgccaggctccagctctcatctatgatgctagtttacggagggcctagtggcctaactccccaacctaggttccgagtcggcctaggtgggtctgggacngtactctattccncacntccgacacgctagngcctgaagtatttgactagtttattatcgtanaactagacgtagacagacgacggtccgtaccgggtcgtaccggttccggacggtaacggggaaccgtaaagggtccggtaaagacgtaaacgggacgtaaacgttgggttacgggctcgggtacgtaacccgtaagtttacccctggttcccgtttacgtacctttacccggttccccgtaacccgttaagtttcccg

SEQ ID NO: 441908 - DNA, 609 bp, Homo sapiens
  misc_feature: GZ8MTXP02IVU7I.11.57.F02.1.454.CMB.2.raw
  modified_base (369)..(369): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctggggagggcttttgttggagaccttgcacttgtactccttgccattcagccagtcctggtgcaggacggtgaggacgctgaccacacggtacgtgctgttgtactgctcctcccgcggtctttgtcttggctattatgccacctccacgccgtccacgtaccagttcgaacttgacctcgacgggtcttcgtggcctcaccgtcccacccaccacgctagtcgtcgaccctcgacggggtcccnccaggcctacccgagggtaaggggctagggatggtattcatacattagctagtagtggtgcgacatactactacgacacgactcgtaggtagaacgggccgtattcacgttacatccgtaccgaagacgaacaagtacggaaccaaacaacctactaactacgttaactacgtaaacggtaaacttaccgaaacgccgtacgtaaggagaacggtacgaaggtaccacgggtactttaag

SEQ ID NO: 441909 - DNA, 690 bp, Homo sapiens
  misc_feature: GZ8MTXP02JCU38.11.57.F02.1.454.CMB.2.raw
  modified_base (426)..(426): a, c, t, g, unknown or other
  modified_base (436)..(436): a, c, t, g, unknown or other
  modified_base (474)..(474): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcggtgggggacgtcgttacggccgacgggggtcccgggggtcctggacgtctcctctcgtctacgtctcgtggtacttccgtccttacgtagtcgtactagtcgacctagtaggaggtcgggtcccgcgacggtcctacggaaggggtaacggggctagggaacgtggtactttacgataactagttaccgcgtagtaggtggcgtaccgactanacttacgacngacgtactcgtaggtaggaaaccgggtcccttaagttnactactactaccgtaccgacgaacgacgaacgtaacggacgtaaccaacctacgtactacgttaacgtaacgtacggtaaacgtaacgtaaccgtaacgaccgtacgtaacggaacggtacggaacgggaccggacggtacgtacgttacgttaacgttagttaacgtacggtacggtaccggtaccggtaccccggtacccggtaccggtaccgg

SEQ ID NO: 441910 - DNA, 659 bp, Homo sapiens
  misc_feature: GZ8MTXP02IN1IU.11.57.F02.1.454.CMB.2.raw
  modified_base (288)..(288): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtacaaaatattaaacaactacttagcctggtacaacagaacctggcaggctccaggctccncatctatgatgactagtttagggagggcccacgtggaccactccccaacccgtaggttcaggtggactaggtcggggtctcggggaactacgtactttgtaacttcctacaccctagtcccgacacgtacccgtagaaacgtccctagtaaagtttattttcgactttaaaggtttttaacttacgttacggttaaccaaacgttaggacgttaagacgtaacgaccgaacggtcccgtcccgggacgggttaccgttccggaaccgaaacggggaaccgtaaggggtaggaacgtacgaacggtacgaaacgttggacgtactcgaccacctagtcctaagttcttacacgttccttacccgcttatacg

SEQ ID NO: 441911 - DNA, 657 bp, Homo sapiens
  misc_feature: GZ8MTXP02GQSFS.11.57.F02.1.454.CMB.2.raw
  modified_base (263)..(263): a, c, t, g, unknown or other
  modified_base (265)..(265): a, c, t, g, unknown or other
  modified_base (269)..(269): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacagtccaccctctcctgcagggccagtacaaaatattaacaactactagctgtaccaananaacngcagctccagctctcatctatgatgactagtttacgggacgggtcccacgtggaccaccgtcccccaacccgtagggttacgaggttcggacgtagggtcggggtcgtacggggactacgtacttctattcctacacctacgtcccgacacgcctaagacgtcctagaagtttatttgactttaagtttaacttacgtcgtacaacgtagacgtacgacgacgcgacggtcccgtaccgggcggtaccggtaccgggaaaccgaaacggggaaccgtaaaggggtaggaaacggtacgaaaacggtacgaacggttcggtacggactcggacctaccgtacttcgtaacgttccgttactaccgttaccctcccgtacttaccgttcg

SEQ ID NO: 441912 - DNA, 597 bp, Homo sapiens
  misc_feature: GZ8MTXP02J4GBC.11.57.F02.1.454.CMB.2.raw
  modified_base (205)..(205): a, c, t, g, unknown or other
  modified_base (299)..(299): a, c, t, g, unknown or other
  modified_base (382)..(382): a, c, t, g, unknown or other
  modified_base (384)..(384): a, c, t, g, unknown or other
  modified_base (416)..(416): a, c, t, g, unknown or other
  modified_base (442)..(442): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctcctggggaaacngtcaccctctcctgcagggccagtacaaaatattaacaactacttagcctggttaccaacagaaacctggccaggctccaggctcctcatctangatgcagtttaggacgggccactcggcactcccacccaggtttcaggtggcgagtgggtctcggggacagtacttcatttccncnccactccgcagtcctagagtccctgtaaagtntttttgctagtttattacgtgtcaanacgcgtagcagcgaggcccgtccgggacgacggttcggccgaagggaccgaaagggtattaacggcaaaggtacgaacgtggttacgggcctcgtacctacctacttccttcgttcctttacctaccgtttacccgttccccgtacctaccttcg

SEQ ID NO: 441913 - DNA, 895 bp, Homo sapiens
  misc_feature: GZ8MTXP02G6DN9.11.57.F02.1.454.CMB.2.raw
  modified_base (205)..(205): a, c, t, g, unknown or other
  modified_base (267)..(267): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtccaccctctcctgcagggccaagtacaaaatattaaacaactacttagcctgttaccaanacgaacctggccaggcctccaggcctcctcatctatgatgctagtttaggacgggcctacgtggaccaccgtccccaacccgtaggttaccaggtcggacgtaggtcggggtcgtacggggacctagtaccgttcctaatttccctacgtacccgtacgttcccccgacgtaaccgtacccgttaaggaccgttacccgttaagggttaaaacgttttacgtttttacggaacgttttaaacgttttttaacgttaaccgtttacgggttaaacctaaaaccggtacgggttaccggttaaccggtacccgaaacggggtaaccccgttaaccgggggtaccccccggttacccgggggttaaccccggggttaacccgggggtttaacccccggggtaaacccggggaaaaacccgggggtaacccgggtaaaaacgggggttaccggggtaaaacggttaaaccccggaaaacggggtacccgggttaaaacgggttccggggttcgggggtacccttaacggggaacccttaaaaccccgtacgggttttaccttccgggtttaccctttaacggtcccctttacccccggttaacccccgttccttaaaccggttttacccggg

SEQ ID NO: 441914 - DNA, 566 bp, Homo sapiens
  misc_feature: GZ8MTXP02GTR4N.11.57.F02.1.454.CMB.2.raw
  modified_base (289)..(289): a, c, t, g, unknown or other
  modified_base (495)..(495): a, c, t, g, unknown or other
  modified_base (502)..(502): a, c, t, g, unknown or other
  modified_base (506)..(506): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgaggccggggggtccctgagactctcctgtctagtctctggattcgccttcagtgactntcgccagtaggaaggtcgggtccccgccgacggcctacccggtaaggggtaaggggctagggaaagtgggtatttccaatactattaacggctagtagtggtgccgaaccatatactacgcagtactctggtagacggccgtatcgatcactcctacagagaacaagtcgacaaacaactcactagtatacgtagaaactcaaacncgctagngacnggaagacgacggctagtacttattagtaagcgacgtacgaccgtcccgtagtcgtaccgg

SEQ ID NO: 441915 - DNA, 650 bp, Homo sapiens
  misc_feature: GZ8MTXP02IGQQD.11.57.F02.1.454.CMB.2.raw
  modified_base (204)..(204): a, c, t, g, unknown or other
  modified_base (263)..(263): a, c, t, g, unknown or other
  modified_base (303)..(303): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccacggagaaattgtgttgacacagtctccggccaccctgtctgcgtctccgtaggggaaacngtccaccctctcctgcagggccagtacaaaatataaacaactattagcctggtaccaanaacgaaacctggaccaggcctccgaggcctcctcatctangatgctaagtttagggacgggccacgtcggaccactccccaaccgtaggttccaggttggacgtagggtcgggtcgtacgggactagtacttcgtacttcacaccacgtccgacctacgtacctaaggcgtacctaagtaaacgttagttttacgacgtttaagttttacgttacgttacgtaactaaacgtacgaccgtagacgaacgtccggacggttccgccgggtaccgtacggtaccggaaccggaacgggacggtaagggtacgaacgtacgaaggacagtcggtcgacgtcgactacgtactcgtaagttccttacgtctaccgtttacccgcttactcg

SEQ ID NO: 441916 - DNA, 610 bp, Homo sapiens
  misc_feature: GZ8MTXP02I36VX.11.57.F02.1.454.CMB.2.raw
  modified_base (204)..(204): a, c, t, g, unknown or other
  modified_base (235)..(235): a, c, t, g, unknown or other
  modified_base (262)..(262): a, c, t, g, unknown or other
  modified_base (286)..(286): a, c, t, g, unknown or other
  modified_base (368)..(368): a, c, t, g, unknown or other
  modified_base (381)..(381): a, c, t, g, unknown or other
  modified_base (405)..(405): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctgtctcccagataccaccggagaaattgtgttgacacagtctccggccaccctgtctgcgtctcctggggaaacngtcaccctctcctgcagggccagtcaaaatnttaacaactacttagcctggttccaanagaaacctgccaggctccagctcncatctatgatgcatttaggagggccactggccagtccccaccaggttcagtggacagtggtctggggacagtacttcattcnctaccgatcccgnagcctagacgcctagaagtatttnactagtttatactgtactaagagacgtagacacgtcgaacggtcctcccgggacggtaccgttaccggacgttaaacggggacccgtaaaggttacgggaaacgttacgaaacggtcgaaaacgtttggacggtacgttcggacctaaccgtactaccggttcgtacgtttcgaccgttacctttcccccgccgtaacgtttccg

SEQ ID NO: 441917 - DNA, 578 bp, Homo sapiens
  misc_feature: GZ8MTXP02JKT0E.11.57.F02.1.454.CMB.2.raw
  modified_base (239)..(239): a, c, t, g, unknown or other
  modified_base (260)..(260): a, c, t, g, unknown or other
  modified_base (350)..(350): a, c, t, g, unknown or other
  modified_base (503)..(503): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctggggagggctttgttggagaccttgcacttgtactccttgccattcagccagtcctggtgcaggacggtgaggacgctgaccacacggtacgtgctgttgtactgctcctccgnggtctttgtcttggctattangcacctccacgccgtcacgtacagtgaacttgacctcgagggtctcgtgctcacgtccaccaccacgcatgtcgacctcgaggggtcccncgaggtcctacccggagggtaggggctagggaatggatttcgatacattagctaaggtgtggtcacgaaccataactctacgcagacttcgaggtaggaaacggggccctattcgactctatcctacgagagaacaagtcggaacaaactacncacgttgtacacgtaaggaaactacgaaacagtacctaaggagtacggtaccggaaggaccgtacggactttaag

SEQ ID NO: 441918 - DNA, 545 bp, Homo sapiens
  misc_feature: GZ8MTXP02ITUEN.11.57.F02.1.454.CMB.2.raw
  modified_base (365)..(365): a, c, t, g, unknown or other
  modified_base (372)..(372): a, c, t, g, unknown or other
  modified_base (423)..(423): a, c, t, g, unknown or other
  modified_base (467)..(467): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgctattttagaaggtgtccagtgcgaggtgcaagtggtgcagtcgtgggggagcttagtccgagggcccggggggtcctgagctctccgtgtctagtctctggtattccgccttcagtgactagtgccatggaggtcgggtccgcgacggcctccgaggggtaaggggctagggatggtatttcatactattacgngagtagnggtgcgacatactactacgcagtactgtggagaacgggctattcatcatcncagacgacaatgacaaacactcactcgtatactagaactacaanacgactgacgacgtcggagacacgggtctacgtattattagtgtagacggacgacccgcccctaacgggttcgaccgg

SEQ ID NO: 441919 - DNA, 641 bp, Homo sapiens
  misc_feature: GZ8MTXP02I7CWR.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgcttattttagaaggtgtccagtgcgaggtgcaagtggtgcgagtcgtgggggagtcttacggtccgagggcccgggggggtccctggacgacctctcctgtctagtctctggattccgccttcagtgactagtcgccagtggaaggtcgggtcccgccgaggcctaccgaaggggtaaggggctagggtaagtcggtatttacataacattacgactaaggtagtggtgccgaacctagtactactacgctagtactctaggtagacgggcctattcactcagttccctaacgagaacgactaagcgaaaccaaactactacacgttagtactacgtaggaaactcaaaacgtcgtaccgtagagtaacgggtacgaacgggacccgtaagtccgttagttaaacttgtttaagtgggtaacgacggtaaccggtacccccgtaccccggttacgggtacgtaaaccccggg

SEQ ID NO: 441920 - DNA, 692 bp, Homo sapiens
  misc_feature: GZ8MTXP02JKQ8J.11.57.F02.1.454.CMB.2.raw
  modified_base (243)..(243): a, c, t, g, unknown or other
  modified_base (359)..(359): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctggggagggcttttgttggagaccttgcacttgtactccttgccattcagccagtcctggtgcaggacggtgaggacgctggaccacacggtacgtgctgttgtactgcctcctcccgnggtcttttgcttggctattatgccacctccacgccgtcacgtaccagttgaactgacctcagggttctcgtggctcacgtcccacacacgctatgtacgaccgtgacggggtcccnccgaggctaccccgaggggtaacgggcaggtaatcggaatttcgaaatacgtaagttacgaccgaagggtttcgtcgggttacgaccggtaaaaccctaagttaacctacctaacgacctaagtaacgttcgttagggtaggaaaccgggggtaccgtactttaccgaacttaccagtttaccctaccgaaggaactaacgaaagttcggaaaccaaaacctaaactaccgtaaatttcggtaaattacccgggaaaagtaaaaccgttaccaaacgttacggaacctaaggaacgaacgtacgggaacggtaacgaccgggtactttaaagg

SEQ ID NO: 441921 - DNA, 751 bp, Homo sapiens
  misc_feature: GZ8MTXP02IKJQ8.11.57.F02.1.454.CMB.2.raw
  modified_base (203)..(203): a, c, t, g, unknown or other
  modified_base (300)..(300): a, c, t, g, unknown or other
  modified_base (720)..(720): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctccagataccaccggagaaattgtgttgacacagtctccggccaccctgtctgcgtctcctggggaaacngtccaccctctcctgcagggccagtacaaaatattaacaactacttagcctggttccaacagaaacctggccaggctacccaggctcctcatctaangatgactaagtttagggacggggccctacgtcggactactccccgaaccgtacggtttacaggtcggctagggttcggggtccgtaggggaacctacgtacgtttacgactttttcccactacccgtactcccggacgtaaccgtacccgtaagacgtcccgttagtaaacgttacgtttttgtaacgttaacgtttttaattaacgttacgttacgaaaactacgggtaccgttaaagacccgtaacggtccgaacggggtccccgttacccggggaacggttaccccgtttaccggggaacccggtaaacggggaacccgtaaacggggtaacgggtaaacggtcgaaaacgggtcggtaaaacgttggggttacgacggtacgaccgtaaccgttaagtccgttaagtcccgtttanaccgttacccgttcccgaaccttacgttacg

SEQ ID NO: 441922 - DNA, 633 bp, Homo sapiens
  misc_feature: GZ8MTXP02F761F.11.57.F02.1.454.CMB.2.raw
  modified_base (265)..(265): a, c, t, g, unknown or other
  modified_base (628)..(628): a, c, t, g, unknown or other
tcagcgagagataccacgaccggtgctcgatttagctcgatatagttgggtttgggggcagggtgtacacctgtggttctcggggctgccctttggctttggagattggttttctcgagtgggggctggggagggctttggttggagaccttgcacttgtactcctgccattcagccagtcctggtgcaggacggtgaggacgctgaccacgacggtacgtgctgttgtactgcctcctcccgcggtctttgtcttggctattancgcacctccacgccgtaccacgtaccagttacgaacttcgacctgacggttctgtcgctcacgtccaaccacacgcagtcgtacgacctcggtacggggtcccaccgaggtcctaccccgaggggtaacggggcttaggaagttcggtaatttcgagtaactagttacgacgtaggttgtaggtcgacgaaccgataactacgtacgtacgacgtactcgtaggacggaacggaccgtattaccatccaaatccgtacaaacgtacgaacaagtacggaactaaaccaacgttcctaactagttacctagttaacgaaactaacgaacaagtaccaagtagaacgtacgaaggacgaccggtnttaag

SEQ ID NO: 441923 - DNA, 547 bp, Homo sapiens
  misc_feature: GZ8MTXP02F8SBX.11.57.F02.1.454.CMB.2.raw
  modified_base (260)..(260): a, c, t, g, unknown or other
  modified_base (301)..(301): a, c, t, g, unknown or other
  modified_base (353)..(353): a, c, t, g, unknown or other
  modified_base (512)..(512): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgcctcctccgcggtctttgtcttggcattangcacctccacgccgtccacgtaccagttgaacttgaccctnagggtcttcgtgctcacgtccaccaccacgcatgtgacctcgacggggtccnccaggcctcccgagggtaaggggctaggaatggatttcatacattagctagtagtggtgcgaccatatactacgcagactctgtagaacgggccgattcgatcatctaccagagacaatcggacaacaactcactagtatactaggaaactacaaaacncgacctaagagacgtacgacggacacggactttag

SEQ ID NO: 441924 - DNA, 650 bp, Homo sapiens
  misc_feature: GZ8MTXP02F5NYO.11.57.F02.1.454.CMB.2.raw
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctatttagaaggtgtccagtgcgaggtgcaagtggtgcagtcgtgggggagcttagtccgaggcccggggggtcctgagactctcctgtctagtctctggtattcgccttcagtgactatcgccatgaaggtcggtccgcgaggcctccgagggtaagggctagggatggtatttcatactagtacgctaggtagtggtgaccgtaccgtataactactaccgacacgtactcgtgtacggaacgggtcccgtattcgatcactcctacgaagacgaactaacgtacgggaacctaaacctaactacctaacgttacggttaactaccgtaaaggtaaactaccgaaacgtaccgtaccgttaggaagggttaacggtacgggacggaaccgtacgggttacgtttaacgttaactttagtttaagtcggttacgacggtaccggacccgttaccccccggtaaggtccggtaacccgggg

SEQ ID NO: 441925 - DNA, 756 bp, Homo sapiens
  misc_feature: GZ8MTXP02IGQGI.11.57.F02.1.454.CMB.2.raw
  modified_base (294)..(294): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaatttgtgttgacacagtctccggccaccctgtctgcgtctcctggggaaacagtcaccctctcctgcagggccagtcaaaatattaacaactacttagcctggttccaacagaaacctgcaggctccagctctcatctatnatgcagtttaggagggccacgtggccactccccaacccgtacgggtttccaaggttcgggacctagggttcggggtctcgggggaacctaggtaacctttacgaactttccctaccacccgacgttcccccggacaaacggtcccccttaaggaaacgtcccttaagggaaacgtttagtttttagaccgtttaaagtttttaacgtttacctacggttaactaaacgtacggtaccggttacgaccgaaacggtccggtaaccgggccccgttcccggggtacgggttaaaccccgggtttccggggaacccggtaaacgggggaacccggtaaaggggtcgggtaaaacggtacggaaaacgttcgggaaaacgttcggtacgggggtcttacgggacctaaacctcgttaccgttgtacccgtttactacttccccgttaccccggtactcgtttaacg

SEQ ID NO: 441926 - DNA, 687 bp, Homo sapiens
  misc_feature: GZ8MTXP02GBGR2.11.57.F02.1.454.CMB.2.raw
  modified_base (206)..(206): a, c, t, g, unknown or other
  modified_base (283)..(283): a, c, t, g, unknown or other
  modified_base (285)..(285): a, c, t, g, unknown or other
  modified_base (291)..(291): a, c, t, g, unknown or other
  modified_base (303)..(303): a, c, t, g, unknown or other
  modified_base (306)..(306): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctacacttgctcccagataccaccggagaaattgtgttgacacagtctccggccaccctgtctgcgtctcgtaggggaaacngtccaccctctcctgcgagggccagtacaaaatattaacaactactagcctgtacaacagaactgcagctccgagcncnatcatnatgctagttggngcngcgcactccacgtgtcaggtgcgtaggtgggtcgacgggactaggtacttcacgtttccacaccgtctccgacgtacgtcccgtaaggaccgtacgtaaggtaacgtttatttacggtactttaaggttttaacttacgtacgtaccgtaaacgtagacggttaacgaccggttaacgccgggtaaccgttcccgggtaccgggtaccgggttaccggtacccggggaaccggtaaaacggggtaacccgggtaaagggtaccgggtaaacgtaacggtaaccggacggtaaaccgggttgtaaccggggtctacggaccgttaaccgtcgtttacctcgtttccgtacgtacccgttccgtccgttaccgtacgtttacg

SEQ ID NO: 441927 - DNA, 623 bp, Homo sapiens
  misc_feature: GZ8MTXP02HIDEX.11.57.F02.1.454.CMB.2.raw
  modified_base (394)..(394): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtccctgagacctctctgtctagtctctggtattcgccttcagtgactatcgccatgaaggtcgggtccgccgaggtcctaccgagggtaacggggctagggaatggtattcgatacattacgacagtagtggtgaccgacagtactactacgnacgtactcgtggtagaacggcccgtattcatactactcctaccaaggtaacgaacaagttacggaacctaaaaccaaccttcaacgttaggttaactccgtaaaggtaaactacgaaacgacgtacccgtaagacggtaaggtacccgggaaaggaaccgtacgggtctaggttaacttattagttggcgacggtacgtacccgtacccccgtagggtaccgaccgggg

SEQ ID NO: 441928 - DNA, 745 bp, Homo sapiens
  misc_feature: GZ8MTXP02HF6ZS.11.57.F02.1.454.CMB.2.raw
  modified_base (265)..(265): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacagtccaccctctcctgcagggccagtacaaatactaacaactacttagcctgttaccaanagaaccgtggccaggcctccgaggcctcctcatctatcgatcgtacttagtttacggacgggtccacgcggtaccaccgtacccccgtaaccgtacgggtttaccaggtcgggtaccgtaggggtcggggttacgtaccggggaactacggtaacctttcctaactttcccacctaccccgtaacgttcccgacgtaaccggtcctaacggaccgtaccgtaagttaaagttcgtttttacggactttaaggttttaacttacgttacgtaactaacgtacgtaccgtaagtaccgaacgaccggtacggtcccgttacccggggacccggttaaccggggttcccggaaaccgggaaccggggtaaaccggtaaaggggttaacggacgtacgaaacgggtaccgtaaaggttcggacgtccgtacgacgtaccgtattccgtaacgttctaacctcttcccggtcctacgtacttccg

SEQ ID NO: 441929 - DNA, 645 bp, Homo sapiens
  misc_feature: GZ8MTXP02G28N6.11.57.F02.1.454.CMB.2.raw
  modified_base (242)..(242): a, c, t, g, unknown or other
  modified_base (320)..(320): a, c, t, g, unknown or other
  modified_base (374)..(374): a, c, t, g, unknown or other
  modified_base (618)..(618): a, c, t, g, unknown or other
tcagcgagagataccacgaccggtgctcgatttagctcgatatagttgggtttgggggcagggtgtacacctgtggttctcggggctgccctttggctttggagatggttttctcgatggggggctggggagggctttgttggagaccttgcacttgtactccttgccattcagccagtcctggtgcaggacggtgaggacgctgaccacacggtacgtgctgttgtactgcctcctcccgnggtctttgcttggctattatgccacctccacgcccgtccacgtaccagttcgaacttcgacctcgagggttcttcggngtcctcaccgtcccacctaccacgctagtcgtacgaccctcggacggggtcccnccgacggtctaccccggaggggtaacggggctaggaactggtaatttcgaattacagttagcgtaggtagtgggtcgacgtaaccaattacgtaacctacgactacgtaccttcgtaggtacggaacggggtccctatttaccgactacacttaccgaccaaggaacgaaaccaagtacggaccaaaacgactactaacgtagttaactcgtaaaggaaaactccaaaacacgacctaaggaanacggtacgaacggtacacggtcttaag

SEQ ID NO: 441930 - DNA, 576 bp, Homo sapiens
  misc_feature: GZ8MTXP02I3UHH.11.57.F02.1.454.CMB.2.raw
  modified_base (249)..(249): a, c, t, g, unknown or other
  modified_base (258)..(258): a, c, t, g, unknown or other
  modified_base (264)..(264): a, c, t, g, unknown or other
  modified_base (270)..(270): a, c, t, g, unknown or other
  modified_base (275)..(275): a, c, t, g, unknown or other
  modified_base (277)..(277): a, c, t, g, unknown or other
  modified_base (279)..(279): a, c, t, g, unknown or other
  modified_base (282)..(283): a, c, t, g, unknown or other
  modified_base (292)..(292): a, c, t, g, unknown or other
  modified_base (297)..(297): a, c, t, g, unknown or other
  modified_base (332)..(332): a, c, t, g, unknown or other
  modified_base (340)..(340): a, c, t, g, unknown or other
  modified_base (351)..(351): a, c, t, g, unknown or other
  modified_base (377)..(377): a, c, t, g, unknown or other
  modified_base (412)..(412): a, c, t, g, unknown or other
  modified_base (526)..(526): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtacaaaatataacaactactanctgtccaanagaacngcagcncagcncnantanntgctatggngcacngcactccaccagttcagtggcaggtggtcgcgganagtacttnacttcacaccnctccgcacgctagcgcctagaacttntttgacttagtttatactcgtaacaactagcgtancacggtcgacgtccggtaccggcgtaccggttcgaacccggtaagggaacccgtaaaggggttaccgaaaggtcgaaaacggcggtaaactgggtacggcgttcacctaaaccngttccgtaaggtcccttacgttacctccgtttaccccgactacgttaccg

SEQ ID NO: 441931 - DNA, 706 bp, Homo sapiens
  misc_feature: GZ8MTXP02IT4GE.11.57.F02.1.454.CMB.2.raw
  modified_base (207)..(207): a, c, t, g, unknown or other
  modified_base (431)..(431): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcgacgggccagtacaaaatacttaaacaacttacttacgccttacggttaccaaacaacgtaaacctggacccaggccctcccgaggtcctcctcatctatgatgcctagttacgggacggtccacgtcggacctactccccgaccgtaggttacgtaggtcggacgtggtcgggtcgtaccgggactagtaccttcgtattccctacnccgtacgtccgaccaccgtaccgtagacgtaccgtagtaaacgtttatttcgaacgtttagttttaacttagttacggtacaaacgtacggttacgaagacgtaacggtccgaccgggtaccgttacccgggacgggttacccggtccggaaaccggtaaacgggaccggaaaagggttacgaaagtacgaaacggtcggtaacgtcggggtctacgtcgaacctacgttctcgttccgttacttactacccttccgtcccgtactacgtttacg

SEQ ID NO: 441932 - DNA, 639 bp, Homo sapiens
  misc_feature: GZ8MTXP02FOY7N.11.57.F02.1.454.CMB.2.raw
  modified_base (279)..(279): a, c, t, g, unknown or other
  modified_base (281)..(281): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatataacaactacttagctgttccaacagaacctgcagctccagcncncatctatgatgctagtttaggagggccaacgtggacactccccaccctaggttcaggtggcaggtggtctgggacagacttcattcctacaccatccgcaacgccttaggacgtccctagtaaacgttattttcgacttagtttacttacgtgttacaaacgtacgtacgtacgcagccgacggccctaccgggacggacgttaccggacgaaacggggaaccgtaaaggggtcggaaagtacgaaacggtccggtaaaacgttggggtacggaccgttacggacccgaaacccacgttaccgttaacgttaccctttacctaacgtttccctttacccccggacctaacctttccgg

SEQ ID NO: 441933 - DNA, 588 bp, Homo sapiens
  misc_feature: GZ8MTXP02GQK51.11.57.F02.1.454.CMB.2.raw
  modified_base (262)..(262): a, c, t, g, unknown or other
  modified_base (357)..(357): a, c, t, g, unknown or other
  modified_base (389)..(389): a, c, t, g, unknown or other
  modified_base (424)..(424): a, c, t, g, unknown or other
  modified_base (551)..(551): a, c, t, g, unknown or other
  modified_base (558)..(558): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcctggggaaacagtccacctctcctgcagggccagtacaaaatataaacaactacttagctggttaccaanagaaacctggccaggctcccgagctcctcatctatgatgactatttaggaggccacgtgccatccccaacctggttcaggtcgcgtaggtggtcncgggacagtactctattccacaccactcccgntaccggcctaaggactcctagaaagtattttacgngttaagttttaattactgtaactaacgagtaccgtagacacgacacggccgtccggacggaccgttccgaccggaaaggtaccgaaaggtaggaacgtacgaacgcgtaaaacgtggtacgcgtacncaccgtntctcgtcttacacctcctaccgcctactcg

SEQ ID NO: 441934 - DNA, 745 bp, Homo sapiens
  misc_feature: GZ8MTXP02GHWW8.11.57.F02.1.454.CMB.2.raw
  modified_base (150)..(150): a, c, t, g, unknown or other
  modified_base (204)..(204): a, c, t, g, unknown or other
  modified_base (302)..(302): a, c, t, g, unknown or other
  modified_base (309)..(309): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacgganaattgtgttgacacagtctccggccaccctgtctgcgtctccgtaggggaaacngtccaccctctccgtgcagggccaagtacaaaatattaaacaactacttagccttaggtaccaaacaagtaaacctggaccaggcctccgaggctccnatactangatgactagtttagggacggtccacgtggccactccccgacgtaggttccaggtcggcgtaggtcggggtactaggggactacgtacttactacgttcctaacacctactacccacgtaccgtaccgttaacgacgtaccctaagtaaacgtttagttttacgtaacttaagtttaattacgttacgtactaaacgtgtaccgtagaccgtaaggtaccgtaccgggtcccgtaacccgggtaccgggttaacccgggttacccggaaaccgggtaaaccggggtaacccggtaaaaggggttaccgggtaaaacggtacggaaaacccgggtaacgttaaccggtggggttaaccggaccgttacggaacctaccgttaacgttcgttaacggttacttacctaccggtttccctacccgtacctacgtttaccg

SEQ ID NO: 441935 - DNA, 742 bp, Homo sapiens
  misc_feature: GZ8MTXP02IISSN.11.57.F02.1.454.CMB.2.raw
  modified_base (204)..(204): a, c, t, g, unknown or other
  modified_base (265)..(265): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccggccaccctgtctgcgtctcctggggaaacngtccaccctctcctgcagggccagtacaaaattattaacaactacttagcctggttccaanagaaacctggcaggctaccaggctcctcatctatgatgctagtttaggacgggtccacgtcggcactccccaccgtaggttcagtggcaggtcgggtctcgggactacgtacttcatttccaccacctactccgaccacgtaccctaggacgtccgtagtaacgtagttttacgacgttaagtttttaacttacgttacgtaactaaacgtacggtacgttacgaccgtaacggtacgtaaccgggtaccccgttacccggggtaccggtaacccgggtttaccccggggaaccggtaaaacgggggtaaacccgggtaaaggggttaacgggtaaaccggttaccgaaaacgggtaccggtaaaacggttcggggtaccggtaccgtacggaccctaaaacccggtttacgttaccgttaacgtttaccgttaccgttacccgtttaccccgtttaccccgtacgttaaccgttcg

SEQ ID NO: 441936 - DNA, 763 bp, Homo sapiens
  misc_feature: GZ8MTXP02IJ9B4.11.57.F02.1.454.CMB.2.raw
  modified_base (425)..(425): a, c, t, g, unknown or other
tcagcgagagataccacgaccggtgctcgatttagctcgatatagttgggtttgggggcaggggtgtacacctgtggttctcgggggctgcccttttggcttttggagattgggtttttctcggagtggggggctggggagggtcttttggttggagaccttgcacttgtactccttgccattcagccagtcctggtgcagggacggtgaggacgctgaccacgacggtacgtgctgttgtactgcctccgtcccggcggtcttttgtcgttggctattatcgacctaccctccgacccgtcccgtacccaccgtaccaggttacgaaccttcgtaccctcgtacggggttcctttcggtcggccttccgaccgtaccccaaccccgaccaccgctagttcgtcgacccgtcggacggggtcccncgacggcctaccccggaaggggtacggggctaggtaattcggtaatttccattaactagttacgcgtaagttggtcggtacgacctaacgaattaacgtaacccgttacgacgaacgtaccgtacggttacggtaacgggaacggggtaccttaagttcctaacgtttactacgtttaacccgtaccgaaaggtaaacaaaccgaacggtaacggtaaaccaaaaccgttaccaacctttaacggtacgtttaactaacgttaaacggaaacttaccggtaaaacacgtaccggtaagaaccgtagggaccgaaacggtacgaccggttactttaagg

SEQ ID NO: 441937 - DNA, 630 bp, Homo sapiens
  misc_feature: GZ8MTXP02I14A2.11.57.F02.1.454.CMB.2.raw
  modified_base (251)..(251): a, c, t, g, unknown or other
  modified_base (260)..(260): a, c, t, g, unknown or other
  modified_base (262)..(262): a, c, t, g, unknown or other
  modified_base (276)..(276): a, c, t, g, unknown or other
  modified_base (281)..(282): a, c, t, g, unknown or other
  modified_base (284)..(284): a, c, t, g, unknown or other
  modified_base (289)..(289): a, c, t, g, unknown or other
  modified_base (307)..(307): a, c, t, g, unknown or other
  modified_base (398)..(398): a, c, t, g, unknown or other
  modified_base (517)..(517): a, c, t, g, unknown or other
  modified_base (555)..(555): a, c, t, g, unknown or other
  modified_base (595)..(595): a, c, t, g, unknown or other
  modified_base (597)..(597): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctacactggctcccagataccaccggagaaattgtgttgacacagtcctccggccaccctgtctgcgtctcctggggaaacagtcacctctcctgcaggccagtacaaaatattaacaactacttancctgtcaananaacctgcagctccngctcnntntatgntgctagtttaggcgggcnctggccactccccaccgtagggtttcaggtggactggtacgggtcgtacggacgtagtaccttctattcccgttaccacgtactcccgganaccgtccgttaagcgtacccttagaaacgtttagttttcgacgttagtttttacgttaacgttcgtaacgtaaaccgaggtacggtacaccgaggtaccgaccgggttcccacccgggngggttaccgtcccgggacgaacggggtaccgaaacggnggtaagtacgacgacgacgtggacgactcggtaccacgtntntaacgtcttctacgtccgtacccgtcaacttcg

SEQ ID NO: 441938 - DNA, 720 bp, Homo sapiens
  misc_feature: GZ8MTXP02IZ146.11.57.F02.1.454.CMB.2.raw
  modified_base (295)..(295): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacggagaaattgtgttgacacagtctccggccacctgtctgcgtctccgtaggggaaacagtccaccctctcctgcagggccagtacaaaatattaaacaactacttagccttaggtaccaacgagaaacctgaccaggctccgagctccncatctatgatgctagtttaggacggtccacgtggacactcccacctaggttcaggtgacgtaggtggtcgtacggggacagtcttcgacttcctacacgtctcccgataccgctaagacgtcctagtaagttattttcgacgttaagttttacgttaacttacggtaacctaaacgtacggtacggttacggacgtacggtaccgaaccggggtccccgttacccggggtaccgggttacccggggtttacccgggaacccgggaaaacggggtaacccgggtaaaacgggttagggaaaaccgggtaacgaaacgggtacccggtaaaacggtttggacggttaccgtacggaccaaccgtacttaccgtaaccgttacgtttacccgactttacccgttaccccgtaacttacgtttaaccgg

SEQ ID NO: 441939 - DNA, 612 bp, Homo sapiens
  misc_feature: GZ8MTXP02IXBSA.11.57.F02.1.454.CMB.2.raw
  modified_base (257)..(257): a, c, t, g, unknown or other
  modified_base (263)..(263): a, c, t, g, unknown or other
  modified_base (269)..(269): a, c, t, g, unknown or other
  modified_base (275)..(275): a, c, t, g, unknown or other
  modified_base (278)..(278): a, c, t, g, unknown or other
  modified_base (376)..(376): a, c, t, g, unknown or other
  modified_base (612)..(612): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcaggccagtacaaaatattaacaactactagctgtccaanagaacngcagcnccagcnctnatctatgatgcagtttagagggcaactggccactccccaccctaagggttcaacgtgggaccaggtgggtactcggtacgacgacgtttctctcttcncctaactcgtaccgacgacgttagacgactacgaagtaactttagtacgactttaattactcgtactaacgacgtacgtacgtacgacgacgccggccgcccgggtccggtaccggttaccggtaccggaacgggaaacggtaacggtaaggtacgtaacgaaccgtagaccgtagtcggtcgtacgaccaccgactacgtcgtacttctacgttacctccccggtcaaccctttn

SEQ ID NO: 441940 - DNA, 565 bp, Homo sapiens
  misc_feature: GZ8MTXP02G6BS4.11.57.F02.1.454.CMB.2.raw
  modified_base (205)..(205): a, c, t, g, unknown or other
  modified_base (261)..(261): a, c, t, g, unknown or other
  modified_base (276)..(276): a, c, t, g, unknown or other
  modified_base (281)..(281): a, c, t, g, unknown or other
  modified_base (289)..(289): a, c, t, g, unknown or other
  modified_base (308)..(308): a, c, t, g, unknown or other
  modified_base (376)..(376): a, c, t, g, unknown or other
  modified_base (400)..(400): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctccagataccacggagaaattgtgttgacacagtctccggccaccctgtctgcgtctccgtaggggaaacngtccacctctcctgcagggccagtacaaaatattaacaactactagctgtaccaanagaactgcagctccngctcncatcatgntgctagtttaggacggccntcggcactccccaccgtaggtcaggtcggcgaggttgggtcgtcgggaactagtacttctactttccncacctacgtcgccagtcctaggcnccgtagagttattttcgacgttaagtttattacgttcgtacaacgtgacgtagcacgcgacggccgtcgcggtacgtcgacgaacgggacagggacgaagtacgagtcgacgtggacgcacgcacctattcgtcgtcttacctacgtccgtacctcgtacttacg

SEQ ID NO: 441941 - DNA, 878 bp, Homo sapiens
  misc_feature: GZ8MTXP02F7WMX.11.57.F02.1.454.CMB.2.raw
  modified_base (268)..(268): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccaccctctcctgcagggcagtacaaaatattaaacaacttacttagcctaggttacccaanagaaacctggccaggctccagctcctcatcatgatgactagtttaggagggcccaacgtcggtaccaacgttcccccaacccgtagggtttaccgaacggttggaccgtaaggggttcggggtaccggttaccgggggaaacctaacgggttaaccttttccgtaaactttccgttaacccacccgtaaacgttcccccgggactaaaccgggtacccccttaaaggggaaaccgtacccgtttaagggtaaaaccgtttacgttttttagaaccgtttaaaggtttttaaactttacggttaacgttaacccaaaacgtaacgggtaccgttaaacggggtacctaacgggtacccgaacgggtaccccgggttccccggggaacccggggttaaacccgggtttacccccggggaaacccgggtaaaccgggggtaaaccccgggaaaagggggtttaaccgggggaaaacggttaaccgggaaaacgggtaaccgggttaaaaccggttccgggttagggtacccggttaccgggaacctacccgttaacgtttacccgtcggtttaccttacgtaccttacccgtttccccggactaccgtttacg

SEQ ID NO: 441942 - DNA, 536 bp, Homo sapiens
  misc_feature: GZ8MTXP02FVJUB.11.57.F02.1.454.CMB.2.raw
  modified_base (303)..(303): a, c, t, g, unknown or other
  modified_base (347)..(347): a, c, t, g, unknown or other
  modified_base (372)..(372): a, c, t, g, unknown or other
  modified_base (497)..(497): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtcgtgggggagcttagtccgaggccggggggtccctgacgactctctgtctagtctctggattcgccttcagtgactatgccatgagtggccncaggctccgagggtagggctaggatggtattcatactataccgngtagtgtgcgacatcgactacgcanctctgagaacggtcgatcatcattcaccaagagaacgatcggaacctaaacgaactcactgtactctaagaatacaacacgcctagaggacgtcggaaaggccgacggtattaggtacttagttnttgtgtacgacgtaccgccccgtaaggcgacgtcccggg

SEQ ID NO: 441943 - DNA, 673 bp, Homo sapiens
  misc_feature: GZ8MTXP02FNNJ3.11.57.F02.1.454.CMB.2.raw
  modified_base (266)..(266): a, c, t, g, unknown or other
  modified_base (664)..(664): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcgtaggggaaacagtccaccctctcctgcgagggccagtacaaaattattaaacaactactagctggtaccaanagaacctgccaggctccagctactcatctatgatgactagtttagggacggtcctaacgtggacctactccccgtaacccgtaggttccgaggtcggagtacgggttggggtcgtaccggggacctacggtactttactacttccctaaccgtaccgaaccgttcccgaacgtacgcccgtaaaggtacccgtccgttaagtaaagtttacgtttcgacgtttaagttttaactacgtcgtaactaacgtcgttacgactacgacggctacgggcccttcgggacgtacggtccgaaggaacgggtactaaggggtcaacggctaacggacgtaacgggttcgaaggttcgaacgtacctacgtacgttctcggttcttaccaccgttccgttacccnctagttccg

SEQ ID NO: 441944 - DNA, 704 bp, Homo sapiens
  misc_feature: GZ8MTXP02JIS8F.11.57.F02.1.454.CMB.2.raw
  modified_base (287)..(287): a, c, t, g, unknown or other
  modified_base (308)..(308): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtccacctctcctgcagggccagtacaaatataacaactacttagcctggtccaacagaacctggccaggctccgaggctccncatctatgatgctagttaggnggccactggacacgtccccacccgtagttcagtcgcgaggtggtcgcgggacagtacttctacttccgtacacctactcccgacacgtacctaggacctcgtacgaagttattttacggacttaagttttattaaccgtcggttactaaacgaggtacgtacgacgaacgccgtaacggcccgtacccgggtaccggtaaccggttcccggaacccgggaaaacggggtaccccgaaaggggttacgggaaaaccgtcgaaaacgtccggtaaaacggttcggtaaccgggtcttacccggccgttaaaacccccgtagtttacccggttcggtttaaacccctttacgtaccccgttttccccgtcccccgggtaaaccctttcgtttaacccgg

SEQ ID NO: 441945 - DNA, 591 bp, Homo sapiens
  misc_feature: GZ8MTXP02JCOE8.11.57.F02.1.454.CMB.2.raw
  modified_base (243)..(243): a, c, t, g, unknown or other
  modified_base (263)..(263): a, c, t, g, unknown or other
  modified_base (373)..(373): a, c, t, g, unknown or other
  modified_base (465)..(465): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctggggagggctttgttggagaccttgcacttgtactccttgccattcagccagtcctgggtgcagggacggtgaggacgctgaccacgacggtacgtgctgttgtactgcctcctccgnggtctttgcttggctattangccaccctccacgcccgtccacgtaccagttcgaacttcgacctcgagggttcttcggtcggcctcgacgttcccaccaccacgctatcgtcgacctcggacggggtccnccagggcctacccggaagggtacggggctagggaatcggtatttcgatactagttacgctaagtagtggtgacgaactataactacgtacgnagtctagtgtagaggccattcatcatctacagacacaagtcgacaaacgactcgtaacttcgtaactcgtaaagaactacaaacgcgtaccgaagacgtaggtaccgaagaccgacggtattaacg

SEQ ID NO: 441946 - DNA, 625 bp, Homo sapiens
  misc_feature: GZ8MTXP02F426C.11.57.F02.1.454.CMB.2.raw
  modified_base (205)..(205): a, c, t, g, unknown or other
  modified_base (264)..(264): a, c, t, g, unknown or other
  modified_base (287)..(287): a, c, t, g, unknown or other
  modified_base (363)..(363): a, c, t, g, unknown or other
  modified_base (375)..(375): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtggggaaacngtccaccctctcctgcagggccagtacaaaatattaaacaactacttagcctgtccaanagaacctgccagctccagctctnatctatgatgctagtttaggaggccagtgcactccccacctaggttcaggtgcagtggtcgtggacagatcattcncaccatcccganacgcctagacgtcctagtaagttattttgactttaagtttattactgttaacaacgtagaccgtagacgaacggcgaacgggtcccgtcccgggtaccggtaccggttaccggaccggtaaacggggaaacccgtaaggggttagaaacggtacgaaacgtacggtaaaccgtggtacggcgtacggtaccaacccgtattaccgttaacgttcctttacacctttccctttaccccgcctaacgtttcg

SEQ ID NO: 441947 - DNA, 701 bp, Homo sapiens
  misc_feature: GZ8MTXP02G7HNT.11.57.F02.1.454.CMB.2.raw
  modified_base (301)..(301): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacagtccaccctctcctgcagggccagtacaaaatacttaaacaacttacttagcctaggttaccaacagaacctggccagcctcccgagcctcctnatctatcgatgactaagtttagggacggtccacgtggcactccccaccgtaggttcaggtggacgtagggtgggtctacgggacacgtacttacgtacttcaccaccgtactccgacgacgtaccgtacggacgtacccttagtaaagttatttttcgacttttaaggtttactttacgttacgtaactaaacgtacgtacgtacgaccaggaccgtacgggtcccggtacccgggacgggttaacccgggttccgggaaccggaaacggggtaaccgtaaagggggtacggtaaaacgttaccggaacggtaacggtaacgttgggacgtacgtacggacctacgtacggtttctaacggttccctttactaccgttcccggtccgactacgtttacgg

SEQ ID NO: 441948 - DNA, 535 bp, Homo sapiens
  misc_feature: GZ8MTXP02GBPW4.11.57.F02.1.454.CMB.2.raw
  modified_base (291)..(291): a, c, t, g, unknown or other
  modified_base (370)..(370): a, c, t, g, unknown or other
  modified_base (375)..(375): a, c, t, g, unknown or other
  modified_base (401)..(401): a, c, t, g, unknown or other
  modified_base (407)..(407): a, c, t, g, unknown or other
tcagcgagagataccacgaccggtgctcgatttagctcgatatagttgggtttgggggaggaactgctcagttaggacccagagggaaccatggaagccccagctaagcttctcttcctcctgctacactggctcccagataccaccggagaaattgtgttgacacagtctccggccaccctgtctgcgtctcctggggaaacagtcaccctctcctgcagggccagtacaaaatattaaacaactacttagcctggttaccaacagaaacctggccaggctccaggctcncatctatgatgactatttggaggccactggcatcccaccaggttcaggtcgcagtggtctggacctagacttcatttcncactnccgcagccctaagcgccttagaagtntttagntaagtttatatgtacaactgcgtagcagcaggcctcggcgtacgttcgaccgaacgggacagggtagagtcaaacggcgaagtcgtagctcggacaccagtcctagtctacactctcccgctatctag

SEQ ID NO: 441949 - DNA, 625 bp, Homo sapiens
  misc_feature: GZ8MTXP02G9L8G.11.57.F02.1.454.CMB.2.raw
  modified_base (403)..(403): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttggggctgtgcttgggttttccttgttgcttattttagaaggtgtccagtgcgaggtgcaagtggtgcgtgtgggaggctagtcgacggccgggggtccggtcgagactctcctcgtcgtacgtcgtctggtagttcgtccttctagtgactatcgcacgtagaggtacgggtccgccgacggacgtccgaggtaacggggtacgtaggtaagtaggtagtttactatactacttagacgagtagtgtagtcgacgtactntactacgcagactcgtgaggtaacgggcgtacttacacgactacgttctaccaacgaacgtaaacgacgtacgtacgaaaccctaacgtactacgtatattacgagtaaacgtacagacacgtgagacggtacgacgacgacgtcgtattaacgttagttacttaggaacggtcgtaaacgggtacccgtaccccggttacggtacggtacccgtaccgggg

SEQ ID NO: 441950 - DNA, 662 bp, Homo sapiens
  misc_feature: GZ8MTXP02I4A6U.11.57.F02.1.454.CMB.2.raw
  modified_base (249)..(249): a, c, t, g, unknown or other
  modified_base (261)..(261): a, c, t, g, unknown or other
  modified_base (374)..(374): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcacctctcctgcagggcagtacaaaatattaacaactacttancctggttccaanagaacctgccagctccagctctcatctatgatgctagtttacggagggccacgtggaccactccccgaaccctacgggttcaacggttggctaggtggggtacgtgggaaccnggtacttactactttcctaccacctacttcccgactaccgtacccgtaacgaccgacccgttaagtaaagttacgttttaggacctttaaagttttacttacttagtaccgaaacgtagtcgtacgtacgaacgccgtaacgggtcccgtccggaccggtaccggttacccggacgtaaacggggaccgtaaaggggttcggaaagttcgaaaacgacggaccgttaggtcgacgtacgtccgacctactccgtttgtcttacctacttcccgtacccgtctacgtcg

SEQ ID NO: 441951 - DNA, 695 bp, Homo sapiens
  misc_feature: GZ8MTXP02I0JYK.11.57.F02.1.454.CMB.2.raw
  modified_base (230)..(230): a, c, t, g, unknown or other
  modified_base (258)..(258): a, c, t, g, unknown or other
  modified_base (276)..(276): a, c, t, g, unknown or other
  modified_base (383)..(383): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtctccggccacctgtctgcgtctcctggggaaacagtccacctctcctgcagggccagtanaaatataacaactacttagctgtccaanagaacctggccagctccngctctcatctatgatgactaagtttagggacgggccaacgtcggaccactccccgacccgtacgggttcaggtcggctaggtcggggtcgtacgggaccagtacttntacttcctcacctacgtcccgacacgtacccctaggaccgtcctaagtaacgttagtttttacgacgtttaaggttttaacttacgttacgtaaccgaaacgtacgggaccgttaagacgacgtacggtacccgggtacccgttccggggacgggttaccggtaccggggaccggtaaacggggtaccgtaaaaggggtgggtaaaacggtacgaaaccggtacggtaaccgttgggtaccgggtactacgaccgtaacctacggttcctcggtttacttaccgtaccgttccttcccgacctacgtttacg

SEQ ID NO: 441952 - DNA, 694 bp, Homo sapiens
  misc_feature: GZ8MTXP02I63YY.11.57.F02.1.454.CMB.2.raw
  modified_base (240)..(240): a, c, t, g, unknown or other
tcagcgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgnggtctttgtcttggctattatgccacctccacgcccgtccacgtaccagttgaacttgacctcgaggttctcgtgcctcaccgtccacccaccacgactagtcgtcgaccgtcggacggggtcccaccgaggcctacccgaggggtaacggggctagggaattggtacttcaatactattacgctaggtagtggtacgacgtaccagtactaccgtcgacgaacgtctacgtaggtacggaacgggccgtaattctaattacgtacttaccgaaccgtaggaaaccgtaacaaacgtacggaaccctaaaaccgtaaccgtaccgtaaaacgtttggttaaaccttcggttaaaacggtaaaactacccgtaaaaacgtccggtaaccgtaacggggtaaacggtaacgggtaccgggaaacggttacccggaacggtttaacgtttaaacggg

SEQ ID NO: 441953 - DNA, 570 bp, Homo sapiens
  misc_feature: GZ8MTXP02FEQ0J.11.57.F02.1.454.CMB.2.raw
  modified_base (205)..(205): a, c, t, g, unknown or other
  modified_base (363)..(363): a, c, t, g, unknown or other
  modified_base (392)..(392): a, c, t, g, unknown or other
  modified_base (452)..(452): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaaacaactacttagcctggttaccaactagaaacctggaccaggctcccaggctcctcatctatgatgactagtttaggacgggccacgtggcatccccaccaggttcaggtgcaggtgggtcngggacagacttcattctcaccatcccganacgcctaagacgtacctagaaagttattttgacttagtttaacttactagtactaaacgngacgtagcagcacggccctcggccggacgttccgaccgaagggacctaggagaagtacaaggcgaaactggtacgctacgcaccaagtcctaagtctacacgtccttccgaccactcg

SEQ ID NO: 441954 - DNA, 616 bp, Homo sapiens
  misc_feature: GZ8MTXP02FYEGJ.11.57.F02.1.454.CMB.2.raw
  modified_base (242)..(242): a, c, t, g, unknown or other
  modified_base (261)..(261): a, c, t, g, unknown or other
tcagcgagagataccacgaccggtgctcgatttagctcgatatagttggggtttgggggcagggtgtacacctgtggttctcgggggctgccctttggctttggagatggttttctcgatgggggctgggagggcttttgttggagaccttgcactttgtactccttgccattcagccagtcctggtgcaggacggtgaggacgctgaccacacggtacgtgctgttgtactgctcctccgnggctttgcttggcatttangccaccctcacgcccgtccacgtaccagtgaactcgacctcgagggtcttcgtggctacacgtcccacccaccacgcatgtcgaccgtcggacggggtccgcgacggcctaccccggaggggtaacggggctagggaatggtactttcaatactattagctagtagtgggtacgacgaacctataatactacgcaagactcgtgtacggaacgggacccgattacactacactcctaccgaagaacgaaacaagtacggaaccaaacaacgtactaacgtacgtactacgtaaggtaaaactaccaaaacgacgacctaaggaacggacggtacggacggaacgaaccggtctag

SEQ ID NO: 441955 - DNA, 739 bp, Homo sapiens
  misc_feature: GZ8MTXP02F35TA.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtagggaacagtccaccctctcctgcagggccagtacaaatattaacaactacttagcctggttaccaacagtaaaccgtggaccgacggctacccgacggcctcctctatctactgtatgtactagtttaggcggccagtcggcacgtccccaccgtggttacacggtcggacgtaggtcgggtccgtacgggacctagtacgttactactccgtacacccgtctacccggaccgttacgacccttaaggtaaacgtcccgttaaaggtaacgttacgtttttacggaacttagttttaacgttactacggttactaaacgtgggtactacgacgtacgacgtaccgggtacccgttcgggaccgggtaaacggttccccggaaccggtaaaccggggtaaccggtaaacgggttacgaaacggtaaccggtaacggtaccggtaagggttcggtaccgggttacggccgtaacctacccgtaagtttaccccggttcgttaccgttaccttaccgtccccgtttacccgaccgttaaccgtcg

SEQ ID NO: 441956 - DNA, 717 bp, Homo sapiens
  misc_feature: GZ8MTXP02GV8OK.11.57.F02.1.454.CMB.2.raw
  modified_base (302)..(302): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaattgtgttgacacagtctccggccaccctgtctgcgtctccgtaggggaaacagtccaccctctccgtgcagggccagtacaaaatattaaacaactacttagcctaggttaccaacaacgaacctcggaccaggcctcccgaggcctccncctatctatagatgtacgtaagtttagggacgggccctaacgtcgggaccctaaccgtaccccctacccgtacggtttacgagggtcggaccgtagggtcggggttcgtaccggggactacggtactttcgtacttaccgtccacctactcccgactaccgaccgtaagacgtaccgtaagtaacgttagtttagactttaaggtttacttacgttacgtaactaacgtacgtacgtaacgacgacgacgacccgggtaccggtcccgggaccgggtacggttacccgggacgaaacggggaacggtaagggtacggaaacgtcgaaaacggtacggtacgacgggtacgtcgacgtaccgaccgtaattccgtcgttactaccgtactcccggttaccctacgtatttacccgg

SEQ ID NO: 441957 - DNA, 686 bp, Homo sapiens
  misc_feature: GZ8MTXP02FOPG8.11.57.F02.1.454.CMB.2.raw
  modified_base (204)..(204): a, c, t, g, unknown or other
  modified_base (424)..(424): a, c, t, g, unknown or other
  modified_base (645)..(645): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccacggagaattgtgttgacacagtctccggccaccctgtctgcgtctccgtaggggaaacngtccaccctctcctgcagggccagtacaaaatattaaacaactacttagcctggttaccaacacgaaacctggacccaggcctccgaggcctcctcatctatgatcgactaggtttaggacgggccacgtcggacctaccgtccccaaccgtaggttacgaggttcggcgtagggttcggggtctaggggtaactacggtactttcgtaatttcccgacncccgtaacgtccgacgtacgtcccgtaaggacgtcccgttaaaggtaagtttaactttttcggaactttaaggttttaacttcgtaggttaacaaaccgtgaccgtagacgaggccgacggtcccgtaccggggtcgtaacggtcccgggacgaacggggtaaccgaagggtacggagtaacgaacgggtacgaacgtggtacgcgtacgaccgtaccgtntccgttaagtccttacgtcctacccgtccgactacgttacg

SEQ ID NO: 441958 - DNA, 596 bp, Homo sapiens
  misc_feature: GZ8MTXP02JHLPA.11.57.F02.1.454.CMB.2.raw
  modified_base (236)..(236): a, c, t, g, unknown or other
  modified_base (298)..(298): a, c, t, g, unknown or other
  modified_base (362)..(362): a, c, t, g, unknown or other
  modified_base (380)..(380): a, c, t, g, unknown or other
  modified_base (399)..(399): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccaagtcaaaatnttaaacaatacttagcctggttaccaaacagaaacctggccaggctccaggctctcatctancgatgacagtttaggagggtccacgtggcactccccacctaggttcacgtggcaggtgggtacngggacagtacttcattcncaccatccgcagtccagancctagaagtatttgactagtttattaacgtcgtacaaaccgagtaccgttaagccgagacgacgggtcctcccgggacgtacggttacggacccgaaaggggactaacgggtagaacgtcgaaagcgaaactggtagcgtacgacgaaacccttcgtacgttcgtacttactaccgtccgtacccgtactacgtacg

SEQ ID NO: 441959 - DNA, 641 bp, Homo sapiens
  misc_feature: GZ8MTXP02JOIUZ.11.57.F02.1.454.CMB.2.raw
  modified_base (282)..(282): a, c, t, g, unknown or other
  modified_base (286)..(286): a, c, t, g, unknown or other
  modified_base (290)..(290): a, c, t, g, unknown or other
  modified_base (384)..(384): a, c, t, g, unknown or other
tcagcgagagataccacgaccggtgctcgatttagctcgatatagttgggtttgggggctctcagagaggtgccttggtcctggattccaaggcatttccacttggtgatcagcactgaacacagaggactcaccatggagttgggctgtgcttgggttttccttgttgcttattttagaaggtgtccagtgcgaggtgcaagtggtgcagtcgtgggggagcttagtccgaggcccggggggtccctgagactctcctgtctagtctctggattcgccttnagtnactntcgcatgaagtcggtccgccgaggcctaccggagggtaaggggcgtaggaagtggttactttacatacattacgcgagtagtggtcgacgactntatactacgcagtactcgtgtagaacgggcctattcatactactaccctacgagtacgaactaaccgttggaaccaaacctaactccaaccgtttagtaacttaaccgtaggtaaaaccttaccgaaacgtacggtacctaggaacggtaacggaccgggaacggtaaccgaaacccggttgtttacggttaaaactttaagtttagttggtacggaacgacggtacccggtcccccgtaaacggttcgaacccggg

SEQ ID NO: 441960 - DNA, 716 bp, Homo sapiens
  misc_feature: GZ8MTXP02GGC62.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaaacaactacttagccttaggttaccaaacagaaacctggacccaaggcctacccgaggcctcctacatctatcgatgactagtttaggacgggccaacgtggccacgtaccccacccgtagggttccaaggtcgtacgtagggtcggtacgtaccggggaactacgtacttaccgtaatttcccgactacccgtactacccgacgtaaccgcccttaaaggcgtaccctaaggtaagtttaacgtttcgaacgtttatttaacgttaccgtagttacaaacgtgaccgttagaccgtagaccgaacgggtcccgtaccgggtacgtaccggttaccgggaaccggtaaagggaacccggtaagggtaacggtaacgaccgtaaaggacccggtaaaagtcggtaacggcgtacggaccgtaaacttcgtacgtttcgtacttaacctacgtttccctaccccgtataacgtttcg

SEQ ID NO: 441961 - DNA, 584 bp, Homo sapiens
  misc_feature: GZ8MTXP02JG3RE.11.57.F02.1.454.CMB.2.raw
  modified_base (206)..(206): a, c, t, g, unknown or other
  modified_base (256)..(256): a, c, t, g, unknown or other
  modified_base (265)..(265): a, c, t, g, unknown or other
  modified_base (269)..(269): a, c, t, g, unknown or other
  modified_base (275)..(275): a, c, t, g, unknown or other
  modified_base (278)..(278): a, c, t, g, unknown or other
  modified_base (280)..(280): a, c, t, g, unknown or other
  modified_base (282)..(286): a, c, t, g, unknown or other
  modified_base (290)..(290): a, c, t, g, unknown or other
  modified_base (294)..(294): a, c, t, g, unknown or other
  modified_base (300)..(300): a, c, t, g, unknown or other
  modified_base (309)..(309): a, c, t, g, unknown or other
  modified_base (329)..(329): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctccgtaggggaaacngtcaccctctcctgcagggccagtacaaatataacactactagctgtcanagaactgcnggcnccagcnctnancnnnnnatgnggcncgtgcnctccaccgngttcagtgctaggtggtacnggggactagtaccttactacttctaccacctactccgaccgcgaccgtaagcaccgtagagttactttgacttacgttttatacgtacgtactaacgagtacgtacgacgctaacgcggtacccgaccgggacggtaccggtccgaaccggaagggtacccgtaagggacggaacgtacgaacggtacgaacgtggacgacgtcgaccacgtacttcgtaaccgtcttaccacttcccgtaccacctcttaccgg

SEQ ID NO: 441962 - DNA, 733 bp, Homo sapiens
  misc_feature: GZ8MTXP02G1PYO.11.57.F02.1.454.CMB.2.raw
  modified_base (207)..(207): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtcctccggccaccctgtctgcgtctccgtaggggaaacngtccaccctctcctgcgagggccagtacaaaatacttaaacaacttacttagccgtgtaccaacgaacgaacctggaccaggcctaccaggcctacctcatctagtacgatgacgttaagtttcgggacgggcctacggtcggacctaaccgtcccccgaccgttacgggttccgaaggtccgggtacgtacggggtcggggttacgtaccggggtaacctagtacccgttataccttacctaccaccgtaccttacgaccgtacgtaccgtagacgtacccgtagtagttactttggactttaagtttaacgttatacggtactaacggacgtacgtacgaccggacgtaccgtacgggtaccccgtaccgggccgggttaaccggtacccgggaaacccgaaacgggggttaccgaaggggtaacggtaaccggtaacgacggtaacgacggtttaggccggttacacacgtaccctagtttccgtggtaccttacgtacctttaccccgacctctaacgttcg

SEQ ID NO: 441963 - DNA, 809 bp, Homo sapiens
  misc_feature: GZ8MTXP02GPWU1.11.57.F02.1.454.CMB.2.raw
  modified_base (204)..(204): a, c, t, g, unknown or other
  modified_base (258)..(258): a, c, t, g, unknown or other
  modified_base (279)..(279): a, c, t, g, unknown or other
  modified_base (286)..(286): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctcgtaggggaaacngtccacctctcctgcagggccagacaaaatattaacaactactagctgtccaanagaactgcaggctccagctcncatctancatgactaagtttaggacgggccacgtggacctacctaccccaacccgtaggttcgacggtcggacgtagggttcgggtcgtaggggacacgtacttcgactttcctaccacctacgtaccgaccgacgtaccccgtaaggccgtacccgttagggtaaacttaagtttttcgaccgtttaagtttttaaacgtttacgtttaccggttaactaaaaccgtaggttaccggtaacggccgtaaacggacccggtaacccgggggtccccggttacccgggggacccgggttaaacccggggtttacccccggggaaaaccggggtaaaacccggggggtaaaccccgggtaaaagggggtttaccgggggaaaacggtttaaccggaaaaccgggaaaccgggttaacgggttacggggttaggggtacccggttacgaacccgtacccgtaaacgtttccggttctttaccggtttaccaccgttttccccgtaacccccggtccctacgttttaacccggg

SEQ ID NO: 441964 - DNA, 714 bp, Homo sapiens
  misc_feature: GZ8MTXP02HO6EA.11.57.F02.1.454.CMB.2.raw
  modified_base (205)..(205): a, c, t, g, unknown or other
  modified_base (260)..(260): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctccagataccaccggagaaattgtgttgacacagtctccggccaccctgtctgcgtctccgtaggggaaacngtccaccctctcctgcagggccagtacaaaatataacaactattagctgtacaanagaacctgcagctccagctctcatctatgatgactaagtttagggaacgggtccacgtcggacacgtaccccaacccgtaaggtttcgaaggtcgggacgtaggggtggggtccgtaaggggactacgtacttacgtattccacgacctaacgtccggacacgtcctaagcgacccgtagtaaacgttagttttagaaccgtttaagtttaactttacgtacgtaactaaacgtacggtacgtacgacgaacgaccggttaaccgggcccgtacccggggtaccggtaaccggttccgggaaaccggtaaacgggggtaaaccgtaacgggggttaaacggaacgggtaaacgaaacggtaaccgtaaaaggtcgggttacgaccggtacggacctaacctaacgttacgttccggttactacggtaacctccgttacccgacctacgtttccg

SEQ ID NO: 441965 - DNA, 634 bp, Homo sapiens
  misc_feature: GZ8MTXP02IPHIH.11.57.F02.1.454.CMB.2.raw
  modified_base (203)..(203): a, c, t, g, unknown or other
  modified_base (259)..(259): a, c, t, g, unknown or other
  modified_base (305)..(305): a, c, t, g, unknown or other
  modified_base (371)..(371): a, c, t, g, unknown or other
  modified_base (373)..(373): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctctggggaaacngtccacctctcctgcagggccagtacaaatattaacaactacttagctgttccaanagaacctgcaggctcccagctcctcatctatcgatgcagtttaggnggaccactggcactccccaccgtaggttcaggtgcaggtggtctggggactagtacttcatttccncnccgtatcccgtacacgcctagacgtcctagtagtattttgacttagttttataacgttcgtacaacgtagtccgtaagctacgtcgaacgggtcccgtacccgggcgtaacccggttacccgggaccgtaaaccggggaacgtaaaggggtaccggtaaaggtacgaacggtacgaacggttcgtacgggtacctcggaccaaccgtagttaccgttcgtttccgttaactactttcccgtacccccggtctaaacgttcg

SEQ ID NO: 441966 - DNA, 624 bp, Homo sapiens
  misc_feature: GZ8MTXP02JNW47.11.57.F02.1.454.CMB.2.raw
  modified_base (205)..(205): a, c, t, g, unknown or other
  modified_base (265)..(265): a, c, t, g, unknown or other
  modified_base (424)..(424): a, c, t, g, unknown or other
  modified_base (458)..(458): a, c, t, g, unknown or other
  modified_base (492)..(492): a, c, t, g, unknown or other
  modified_base (591)..(591): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctacactggctcccagactaccaccggagaaattgtgttgacacagtctccggccaccctgtctgcgtctccgtggggaaacngtcaccctctcctgcagggccagtcaaaatattaaacaactacttagcctggttaccaanagaacctggccaggctcccaggcctctcatctatgatcgtacagtttaggacgggtccacgtggacctactaccccgaacccgtagggtttccaacggttcgggccaggtcggggttcctacgggggaccctaaggtctttccaactttctccacccgntacccggcaacgtccaggacgtccctagaaattntttgattagtttacgtatgtacaagcgtacgtancagcgacgtccgtccggacgtacggtaccgacgaacggtaccgaaggtggaagtacgaacgtacgacgttggtacgcgtacgacctaccgtacgtacgngttaccttactacgttaccgtccctaacgtctc

SEQ ID NO: 441967 - DNA, 638 bp, Homo sapiens
  misc_feature: GZ8MTXP02FIVPI.11.57.F02.1.454.CMB.2.raw
  modified_base (205)..(205): a, c, t, g, unknown or other
  modified_base (263)..(263): a, c, t, g, unknown or other
  modified_base (265)..(265): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (281)..(281): a, c, t, g, unknown or other
  modified_base (283)..(283): a, c, t, g, unknown or other
  modified_base (285)..(285): a, c, t, g, unknown or other
  modified_base (293)..(293): a, c, t, g, unknown or other
  modified_base (304)..(304): a, c, t, g, unknown or other
  modified_base (316)..(316): a, c, t, g, unknown or other
  modified_base (320)..(320): a, c, t, g, unknown or other
  modified_base (324)..(324): a, c, t, g, unknown or other
  modified_base (332)..(332): a, c, t, g, unknown or other
  modified_base (337)..(337): a, c, t, g, unknown or other
  modified_base (347)..(347): a, c, t, g, unknown or other
  modified_base (349)..(349): a, c, t, g, unknown or other
  modified_base (351)..(351): a, c, t, g, unknown or other
  modified_base (374)..(374): a, c, t, g, unknown or other
  modified_base (404)..(404): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtggggaaacngtccaccctctcctgcagggccagtacaaaatattaacaactacttagcctgtccaananaaccngcngcncagcncnantatgatgnagttggagccntgcactccaccngtcngtgngagtggtnggacngactcattcncncnctcgcacgctagctctagaattnttgacttagtttaattactcgtactaacgnggtacgtacgacgtagacgacgggtcccgtacccgggtacggtaccggttaccgggaaccggaacggggtaaccggaacggggttacgggaaaacgttaccggaaaacggtacggtaacggttaggtaaccggggtcttaccggacccgtttaacccgacgtttaccgtttaacggttcccctttacggtacccctttacccgtttacccccggtacccttaacgtttacccgg

SEQ ID NO: 441968 - DNA, 765 bp, Homo sapiens
  misc_feature: GZ8MTXP02HSFE8.11.57.F02.1.454.CMB.2.raw
  modified_base (265)..(265): a, c, t, g, unknown or other
  modified_base (294)..(294): a, c, t, g, unknown or other
  modified_base (418)..(418): a, c, t, g, unknown or other
  modified_base (424)..(424): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggccagtacaaaatattaaacaactacttagcctaggttccaanagaaacctggccaggctaccaggcctccncatctatcgatgactagtttaggacgggccctaacgtggaccacgttcccccgaacccgtagggtttccaggtaggccgtagggtcgggttcgtaccggggactaggtaccttcgaactttccncacctntccggacacgcctaagacgtcctagtaaacgtacgttttagacttaaggtttatttaaccgtaggtttaacctaaacgaaacggtccgttaaagtcgaaacgggaccaaccggggtcccgttaccgggaccgggtaaccgttccgggaacccggaaacgggggaacccgtaaaggggttaaccgggaacggttaaccggaaacggaaccggtaaacccggtttaaggggtccgtaaaccgggtcggtaacccgaacccgttaacttacccggttccgtttaacccttcccggttaaaacccgttccccctttttacccccggaccgtttaaactttcccgg

SEQ ID NO: 441969 - DNA, 655 bp, Homo sapiens
  misc_feature: GZ8MTXP02GA6ZQ.11.57.F02.1.454.CMB.2.raw
  modified_base (208)..(208): a, c, t, g, unknown or other
  modified_base (278)..(278): a, c, t, g, unknown or other
  modified_base (321)..(321): a, c, t, g, unknown or other
  modified_base (326)..(326): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgccgtctccgtaggggaaacngtccaccctctcctgcgagggccaagtacaaaatacttaaacaaactacttagccttaggttacccaaanaacgaaacctggacccaggcctcccgagtcctcctcatctatnatagntagtttaggcggccagtcggcacctcccgacgtaggttcagtcgacgtaggtggtctacgggactagtctactcttccacgacctcgaccgtacgacgtccgtaaggcttaccgtacgtattacgtttagacgtttagtttaacgttacgtccgtaaagttaaccgagtacgtacgacgtacgacgtacggcccgttacgggtaccggtaccgggttaccggaccggtaaacggacggtaaagggtacggacgtacgaacggtaacgtcgtaggtccgtacgacgtacactacgtctcgttactctacttcccgtccgtctacgttacg

SEQ ID NO: 441970 - DNA, 648 bp, Homo sapiens
  misc_feature: GZ8MTXP02JKOZ1.11.57.F02.1.454.CMB.2.raw
  modified_base (265)..(265): a, c, t, g, unknown or other
  modified_base (295)..(295): a, c, t, g, unknown or other
  modified_base (324)..(324): a, c, t, g, unknown or other
  modified_base (404)..(404): a, c, t, g, unknown or other
tcagcgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacagtccaccctctcctgcagggccagtacaaaatattaaacaactacttagctgtaccaanacgaactggcaggctccagctctcatctangatgactagttaggacggtccacgtgacncctacccgaccgtaggttcgaggtcggcgtaggtcggggtctaggggacagtactctacgttcctacacctactccgacncgtacccgtagacgtcctagtaagtattttgacgttagtttatagtcgtacaacgtagtacgagtacgaagcgaacggcccgttccgggaccgtaacggttccggaaccgtaaacggggacgtaacggggtaacggtaaacggtacgaaacggtaccggtacgttggacggtacgtacgaccgacgtaacgttcctaaggtttccttaacgtacccgttacccgttaccccgtacctacttccg

SEQ ID NO: 441971 - DNA, 724 bp, Homo sapiens
  misc_feature: GZ8MTXP02I4EQ7.11.57.F02.1.454.CMB.2.raw
  modified_base (203)..(203): a, c, t, g, unknown or other
  modified_base (302)..(302): a, c, t, g, unknown or other
  modified_base (304)..(304): a, c, t, g, unknown or other
  modified_base (308)..(308): a, c, t, g, unknown or other
  modified_base (310)..(310): a, c, t, g, unknown or other
  modified_base (375)..(375): a, c, t, g, unknown or other
tcagcgagagataccacgaccggtgctcgatttagctcgatatagttggggtttgggggaggaactgctcagttaggacccagagggaaccatggaagccccagctcagcttctcttcctcctgctactctggctccagataccaccggagaattgtgttgacacagtctccggccaccctgtctgcgtctcgtggggaaacngtccacctctcctgcgaggccaagtacaaaatattaaacgaactacttagccttggtaccaagacgaaaccgtggaccacggcctaccgaggcctccananctangntcgactagttaggacggtccagtcggccacctccccgaccgtagtcgaggtcgacgtggtcgggngtaccggggactagtactttccatttcccaacctcctacgtcccgactaccgtcccgtaaggactccgtaaagtaagtttacgtttcgaacgtttaattttacgtttaacgtacgttaaaccgtaaactacgggtacgttacgaccgtacgggttacccgaaccggggttacccgtccgggtacccgggttaccgttaaccccggggaaccggttaaaggggaacccgggtaaagggtacggaacgttaacccgaaaggtaaccggttaacggtttcgggaacggttccgtcgaaccggtacctggttactcgttacttacgtcctacccgttcctcgtaactttccgg

SEQ ID NO: 441972 - DNA, 691 bp, Homo sapiens
  misc_feature: GZ8MTXP02FNOVY.11.57.F02.1.454.CMB.2.raw
  modified_base (288)..(288): a, c, t, g, unknown or other
  modified_base (291)..(291): a, c, t, g, unknown or other
  modified_base (368)..(368): a, c, t, g, unknown or other
  modified_base (663)..(663): a, c, t, g, unknown or other
tcagcgagagataccacgaccggtgctcgatttagctcgatatagttgggtttggggggaggaactgctcagttaggacccagaggggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccaggcnctnatctatcgatgctagtttacgggagggtcccacgtggaccactcccccaccccgtagggttccagggttcggtacgnggttcggggtacgttccggggaacctaacgtactttactactttcccgtacaccccaacgttccccgacgtacgtaccctaggtaaccggtaccctaggggtaaaaaccttgttttttaacggaccttaaggtttttaaattaccgtaggttacaaaacgtgacgtaacggctaacgcgaaccggtcctaccgggtcgtacggttcccgaaccggaaacggggaccctaaagggtacgggtaaacgtcgaaaacgaccgtaaaacgtggtacggactacggaccactaactcgtnttctctactccggtttcccactattacg

SEQ ID NO: 441973 - DNA, 728 bp, Homo sapiens
  misc_feature: GZ8MTXP02J1JXW.11.57.F02.1.454.CMB.2.raw
  modified_base (261)..(261): a, c, t, g, unknown or other
  modified_base (303)..(303): a, c, t, g, unknown or other
  modified_base (401)..(401): a, c, t, g, unknown or other
tcagcgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaatattaacaactacttagcctggttaccaanagaaacctggccaggctcccaggctcctcatctatcgatcgntatttaggcggggccactgggccaactccccaccccgaggtttccaggtggccgtagttcggggtcctaggggacctaggtaccttcgatttcctacnccgtaattcccggacagtccccgtaggtaaacgcccttgggaaactattttcgcgtagttttactttaaaccgttgtacctaacgtagtaccgtaaacgtcgtaacgtacggacggtacccgttcccgggaccgggttaccggtttacccgggtaacccggtaaacgggggaacccccgtaaaacggggttggggaaaacgttacccgaaaagggtcccggtaaaaccggttgggttacggggaccttaagggcccgacctaacgttaccttcgggtttcccttacgtaccctttccgtttaacccccggccgttaaccgtttaccg

SEQ ID NO: 441974 - DNA, 852 bp, Homo sapiens
  misc_feature: GZ8MTXP02JYVZ9.11.57.F02.1.454.CMB.2.raw
tcagcgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtcctccggccaccctgtctgcgtctccgtaggggaaacacgtccaccctctcctgcacgggcagtacaaaatacttaaacaactacttacgcctaggttaccaaacagaaaccctcggaccacggcctcccgacggcctcctacagttctatcgatcgactaagtttacgggacgggtccacgtcggcctacgtccccaacccgtaggttacaggtcggacgtagggtcggggtcgttacggggactacgtacttcacttcctacgtacctctacccggtacacggtcctaacgggtacgtcgtaaacggttaaacggtttacgttttacgggttaacctttaagggtttttaaacctttacggttacgtttaaaccggaaaccggtacgggttacccgttaagggaacccgtacgggtaacccgggtaccgggtttaccccgggtcccgggggtaccgggtacccgggggtttacccccggggaaaccgggggaaaacgggggttaaccccgggtaaaagggggtaccgggtttaaaaccggaccgggtaaaacgggttaccgggaaaacggtttcgggggcgttacccggtaggttacccccgaaaacccttcgggtttactttccgttactttacccggtacccttttcccggtacccccggtaactttacgtttaccggg

SEQ ID NO: 441975 - DNA, 534 bp, Homo sapiens
  misc_feature: GZ8MTXP01AJZPC.52.7.A07.1.454.CMB.2.raw
tcagcgcagtacgacacgaccggtgctcgatttagcacgtgtcgcaggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggagttataaacttgtctctggtaccaacaacacccggcaaagcccccaaactcatcattatgaggtcactaagcggccctcgggggtttctaatcgcttctctggctccaagtctcggcgacacggccctccctgacaatctcttggctccaggctgaggacgaggctgattattttgctgctcatatgcgggtagtagtaattatgttcttcggaagtgggaccacggtcaccgtcctgggtcagcccaacggccaaacccacttcgcactctcgttcccaccctccttctaacttcgaac

SEQ ID NO: 441976 - DNA, 540 bp, Homo sapiens
  misc_feature: GZ8MTXP01BYSXT.52.7.A07.1.454.CMB.2.raw
  modified_base (367)..(367): a, c, t, g, unknown or other
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgctggaaccaacaatgatgttgggattataaacttgtctctggtacaacaacaccccgcaaagccccaaactcatcatttatgaggtcactaagcggcccgtcgggggtttactaatcgcttctctggctcaagtcctggcgacaccggcctacccngcaatctcttggctcaggctgacgacgaggctagtatttagttttcgctgctcatatggcggggttagtagttaattatgtcttggaagtcgggactcggtcaccgtcgtggtcacgcccaaggcccaacccacgttcgcaactctcgttcccaccttcctcttaagtaaccg

SEQ ID NO: 441977 - DNA, 594 bp, Homo sapiens
  misc_feature: GZ8MTXP01C3EXP.52.7.A07.1.454.CMB.2.raw
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgccgccggaaccaacaatgatgttgggagttataaacttgtctcctggtaccaacaacaccccggcaaacgcccccaaactcatcatttatgaggtcactaagcggccctcgggggtttctaatcgctttctctggctccaagtctcggcgacacggccctccctagacaatctcttggctccaggctgaggacgaggctgtatttattttgcttgctcatatgcgggttagtagttaattatgttcgttcggaagttgggaacctacgggtccaccggttccgtggggttccacggccccgaaacgggccccaaaccccgtacttcggttcccttaccttcctcgttccccctaaccccttccttacttaacttaaccggtaacg

SEQ ID NO: 441978 - DNA, 527 bp, Homo sapiens
  misc_feature: GZ8MTXP01BA1GV.52.7.A07.1.454.CMB.2.raw
tcagcgcagtacgacacgaccggtgctcgatttagcacgtgtcgcagggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggagttataaacttgtctcctggtaccaacaacacccggcaaagcccccaaactcatcattatgaggtcactaagcggccctcgggggttctaatcgcttctctggctcaagtctcggcgacacggcctccctgacaatctcttggctccaggctgagacgaggctgattattttgctgctcatatgcgggtagtagtaattatgtcttcggaagttggaccacggtcaccgtcctgggtcagcccaaggccaaacccacttcgttcactctgtcccgccctccttctaattcgaac

SEQ ID NO: 441979 - DNA, 547 bp, Homo sapiens
  misc_feature: GZ8MTXP01BQ04S.52.7.A07.1.454.CMB.2.raw
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggattataaacttgtctcctggtaccaacaacaccccggacaaacgcccccaaactcatcattatgagtcactaagcggccctcgggggtttctaatcgctttctctggctccaagtctggcgacacggcctccctgacaatctctgctcaggctgaggacgaggctgtatttattttgctgctcatatgcgggtagtagttaattatgtcgttggaagtgggaccacggtcaccgtcgtgggtctacgcccaaaggcccaaaccccgattcgcacctctcgttccccacccttccttactaacttaacgtaacg

SEQ ID NO: 441980 - DNA, 545 bp, Homo sapiens
  misc_feature: GZ8MTXP01BZOU9.52.7.A07.1.454.CMB.2.raw
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggattataaacttgtctctggtaccaacaacaccccggcaaacgcccccaaactcatcatttatgaggtcactaagcggccctcgggggtttctaatcgcttctctggctccaagtctcggcgacacggcctccctgacaatctctggctcagctgagacaggctgtattattttgctgctcatatggtcgggttaggtagttaattatgttcgttggaaggtggaacctcggtcaccgtcccgtggggtcacgcccaaggcccaaccccattcgttcactctcgttcccaccctcttctaacgttcgtaac

SEQ ID NO: 441981 - DNA, 521 bp, Homo sapiens
  misc_feature: GZ8MTXP01CHRA0.52.7.A07.1.454.CMB.2.raw
  modified_base (388)..(388): a, c, t, g, unknown or other
  modified_base (434)..(434): a, c, t, g, unknown or other
  modified_base (447)..(447): a, c, t, g, unknown or other
  modified_base (456)..(456): a, c, t, g, unknown or other
  modified_base (480)..(480): a, c, t, g, unknown or other
  modified_base (489)..(489): a, c, t, g, unknown or other
  modified_base (494)..(494): a, c, t, g, unknown or other
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctctgcgcgaaccaacaatgatgttggagttataaacttgtctctggtaccaacaacaccccggcaaacgcccccaaactcatcatttatgaggtcactaagcgccgtcgggggttctaatcgtcttctctgctcaagtctcgcgacacggcctccctgacaatctcttgctccagctgagacgnggctgatttatttgctgctcatagtgcggttagtagttaatatgtnttcggagtggacngtcacgtcngggtcagcccaaggcccaaacccngttcgttcncttcnttccccgctccttctaacgttcgtaac

SEQ ID NO: 441982 - DNA, 592 bp, Homo sapiens
  misc_feature: GZ8MTXP01AQRDG.52.7.A07.1.454.CMB.2.raw
  modified_base (292)..(292): a, c, t, g, unknown or other
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggagttataaacttgtctctggtacaacaacacccggcaaagcccccaaatcatcattangagtcactaagcgcctgggggttctaatcgctttctctggctccaagtctcggcacacggcctccctagacaatctcttggctccaggctgagagaggctgtattattttgcgtgctcatagtagtcgggtaggtagtaattagtgttcgttcggaagttcgggaaccgtacggttccgaaccgtccgtcggggtaacacggccccaaacggccccgaaacccctcgttccgttccttaacccgttccttaccgtttcccccaacccccgttcccttacctaaccgttaaccggtaaccg

SEQ ID NO: 441983 - DNA, 518 bp, Homo sapiens
  misc_feature: GZ8MTXP01C5KGU.52.7.A07.1.454.CMB.2.raw
  modified_base (330)..(330): a, c, t, g, unknown or other
  modified_base (410)..(410): a, c, t, g, unknown or other
  modified_base (446)..(446): a, c, t, g, unknown or other
  modified_base (483)..(483): a, c, t, g, unknown or other
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctctgcgcgaacaacaatgatgtggattataaacttgtctctggtaccaacaacaccccggcaaagcccccaaactcatcattatgaggtcactaagcggccctcgggggtttctaatcgctttcnctggctccaagtctggcacacggcctccctgacaatctcttggctcagctgagacgaggctgatttatttgctgctcatntgcgggtagtagttaatatgtcttggaagtggaccngtcaccgtcgtgggtcagccctaaggcccaaaccccnttcgcactctcgttcccgccctcttctaacgcgtc

SEQ ID NO: 441984 - DNA, 543 bp, Homo sapiens
  misc_feature: GZ8MTXP01D1CF7.52.7.A07.1.454.CMB.2.raw
  modified_base (253)..(253): a, c, t, g, unknown or other
  modified_base (283)..(283): a, c, t, g, unknown or other
  modified_base (474)..(474): a, c, t, g, unknown or other
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctctgcgccgaacaacaatgatgttgggattataacttgctctgtacaanacacccggcaaagccccaatcatcatttangagtcactaagcggcccgtcgggggtttctaagtcgtcttctctggctccaagtctcggcacacggccctccctagacaatctcttggctccaggctgaggacgaggctgtatttatttttgcttgctcatatgtcgggttagtagttaattattgtcgttcggagtcgggacctacggtcaccgttccgnggggtcacgacccaacggcccaacccgattcgttcactctcgttccccgccctcttctaacttcgtaac

SEQ ID NO: 441985 - DNA, 522 bp, Homo sapiens
  misc_feature: GZ8MTXP01AP7LG.52.7.A07.1.454.CMB.2.raw
  modified_base (414)..(414): a, c, t, g, unknown or other
  modified_base (438)..(438): a, c, t, g, unknown or other
tcagcgcagtacgacacgaccggtgctcgatttagcacgtgtcgcagggggtcgacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgtgggagttataaacttgtctctggtaccaacaacaccccggcaaagcccccaaactcatcatttatgaggtcactaagcggcctcgggggtttctaatcgctttctctggctccaagtctcggcgacacggcctccctgacaatctcttggctcaggctgagacgaggctgattattttgctgctnatatgcggtagtagtaattatgtnttcgagtggaccacgtcacgtctgggtcacgcccaggcccaacccacttcgcactctcgtcccctaccctcttcctaattcgtc

SEQ ID NO: 441986 - DNA, 585 bp, Homo sapiens
  misc_feature: GZ8MTXP01D1APC.52.7.A07.1.454.CMB.2.raw
  modified_base (218)..(218): a, c, t, g, unknown or other
  modified_base (286)..(286): a, c, t, g, unknown or other
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcacatctctgcgcgaacaanatgatgtggattataacttgtctctagtaccaacaacacccggcaaacgccccaaactcatcatttangagtacactaagcggtccccgttcgggggtttactaagtcgtctttctcttggcctaccaagtctcggcgacacggtcctccctagacaagttctcgttacggctaccgagggtctaggacggacgagggtctgtatttagttttgcttgctcatatggcggttaagtagtaatttatgttcgtcggaagtcggaaccgtacggtctaccgttcgtgggtaacacggacccgtaacggcccgaaaccctattcgttcttaccttctccgttcccgtccctcttactaacgttcgtaacg

SEQ ID NO: 441987 - DNA, 578 bp, Homo sapiens
  misc_feature: GZ8MTXP01ELPX3.52.7.A07.1.454.CMB.2.raw
  modified_base (218)..(218): a, c, t, g, unknown or other
  modified_base (256)..(256): a, c, t, g, unknown or other
  modified_base (260)..(260): a, c, t, g, unknown or other
  modified_base (278)..(278): a, c, t, g, unknown or other
  modified_base (416)..(416): a, c, t, g, unknown or other
  modified_base (546)..(546): a, c, t, g, unknown or other
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctctgcgcgaacanatgatgtggattataattgctctgtacaacacacccgnaacnccccaatcatctatttangagtacactaagcgtcccgttgggttactaatcgtctttctctgcctcaagtctcggcacaccggtcctcccgtagaacaatctcgttcggctaccgaggctaggaggacgaggcttagtatttattttgcttgtctntagtagttgggtacggttagtaaggttaatttagtagttcgtacggtaagtcgggtaaccgtcggtacctaccggtcgtgggtaacgacgcccgaaacgcccgaaacccctagttcgttcttactttccncttcccctaccctcttactaacttcgtaaccg

SEQ ID NO: 441988 - DNA, 621 bp, Homo sapiens
  misc_feature: GZ8MTXP01BM8ME.52.7.A07.1.454.CMB.2.raw
  modified_base (211)..(211): a, c, t, g, unknown or other
  modified_base (223)..(223): a, c, t, g, unknown or other
  modified_base (240)..(240): a, c, t, g, unknown or other
  modified_base (245)..(245): a, c, t, g, unknown or other
  modified_base (253)..(253): a, c, t, g, unknown or other
  modified_base (262)..(262): a, c, t, g, unknown or other
  modified_base (268)..(268): a, c, t, g, unknown or other
  modified_base (272)..(272): a, c, t, g, unknown or other
  modified_base (275)..(275): a, c, t, g, unknown or other
  modified_base (279)..(279): a, c, t, g, unknown or other
  modified_base (330)..(330): a, c, t, g, unknown or other
  modified_base (409)..(409): a, c, t, g, unknown or other
  modified_base (415)..(415): a, c, t, g, unknown or other
  modified_base (553)..(553): a, c, t, g, unknown or other
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtcctcctggacagtcgatccaccatctccngccgacgaacanatgatgtggattatatntctcngacacacnccgacaacncccaancatnatngagnactagcgtccgtgggttacatcgtcttctcgcgctaccagtcgtcgcgacncggtccctcctaacgactaactctcgttcgccttcgacgggctggacggtacgtcgtagttggttaatttcgttttacncggttnacttacagttaagtggtacggttaagggttatttaagttgtacggttacgttaccggggaggttacggtaaccgaccggttcctaaccggttccggttaggcccgaacgttaccccggaaacgaccctaaaccccggntttaccggccttacctaacccgttcccgttaaccccaacccctttcgaccttaacgttccggtaaccg

SEQ ID NO: 441989 - DNA, 557 bp, Homo sapiens
  misc_feature: GZ8MTXP02JA9WN.52.7.A07.1.454.CMB.2.raw
  modified_base (219)..(219): a, c, t, g, unknown or other
  modified_base (286)..(286): a, c, t, g, unknown or other
tcagcgcagtacgacacgaccggtgctcgatttagcacgtgtcgcaggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccgaacaanatgatgttggattataacttgtctctggtaccaacaacacccggcaaacgccccaactcatcattangaggtcactaagcggcccgtcggggttctaatcgcttctctcggctccaagtctcggcgaccgacggccctccctcgacattcctctttcggccttcccgaggcctgacggacgaggctgtatttattttgctgctcatatggcgggtagtagttaattatgttcttacggaagtggaacgacggtcaccgtcgtgggtacacgacccaacggacccaacccgtactcgtacctactccgtccgttccccgcctcctactacgtacgtacg

SEQ ID NO: 441990 - DNA, 500 bp, Homo sapiens
  misc_feature: GZ8MTXP02FW7P1.52.7.A07.1.454.CMB.2.raw
  modified_base (358)..(358): a, c, t, g, unknown or other
  modified_base (403)..(403): a, c, t, g, unknown or other
  modified_base (421)..(421): a, c, t, g, unknown or other
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaacaacaatgatgttgggattataaacttgtctctggtaccaacaacacccggcaaagccccaaactcatcatttatgaggtcactaagcggccctcggggttctaatcgcttctctggctcaagtctgcgacacggcctccngacatctctgctcagctgagcgagctgatttatttgctgctcatntgcggtatagtatatgtntcgagtgacacgtcacgtctggtcagccaacggccaacccgactcgtcactcgtcgttcccaccctcctctactcgtac

SEQ ID NO: 441991 - DNA, 578 bp, Homo sapiens
  misc_feature: GZ8MTXP02HJV13.52.7.A07.1.454.CMB.2.raw
  modified_base (531)..(531): a, c, t, g, unknown or other
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgctggaaccaacaatgatgtggattataacttgtctctggtaccaacaaccacccggacaaacgccccaaactcatcattatgagtcactagcgtccgtcggggttctaatcgtcttctctggtctccgaagtccctcggcgacaccggccctccctgacaacttctcttcggctccgaggtctgaggacgaggtctgtatttagttttgctgtctcattacgtggtacgggtaattagtaattagtgttcgttacggtaaggtcgggtacctacggtccgtaccgtccgttcggcacggacccaacggccctaaaccccncgtcgtcctaacgtcctccgttacccctaccctcctactactaaccg

SEQ ID NO: 441992 - DNA, 557 bp, Homo sapiens
  misc_feature: GZ8MTXP02H0B6J.52.7.A07.1.454.CMB.2.raw
  modified_base (219)..(219): a, c, t, g, unknown or other
  modified_base (286)..(286): a, c, t, g, unknown or other
  modified_base (324)..(324): a, c, t, g, unknown or other
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcacatctcctgcgccgaacaanatgatgtggattataacttgtctctgtaccaacaccacccgacaaacgccccaaactcatctattangagtcactagcggccgtggggtttacaatcgcttctcnggtctcaagtctcggcacgacggcctcctgacatctctcgctccaggctggacgacgagctagtactttattttgcttgtactcattagtggtacggttagtaagttaattagtgttacgttaggaagtcgggacctacggtccgtacccgtcgtaggtcaccggaccgaaacgcccaaacccgtctacgtccaacttccgtccttaccccaccctcctactacttaccgacg

SEQ ID NO: 441993 - DNA, 525 bp, Homo sapiens
  misc_feature: GZ8MTXP02HBN7Z.52.7.A07.1.454.CMB.2.raw
  modified_base (300)..(300): a, c, t, g, unknown or other
  modified_base (371)..(371): a, c, t, g, unknown or other
  modified_base (390)..(390): a, c, t, g, unknown or other
  modified_base (398)..(398): a, c, t, g, unknown or other
  modified_base (409)..(409): a, c, t, g, unknown or other
  modified_base (411)..(411): a, c, t, g, unknown or other
  modified_base (413)..(414): a, c, t, g, unknown or other
  modified_base (416)..(416): a, c, t, g, unknown or other
  modified_base (422)..(422): a, c, t, g, unknown or other
tcagcgcagtacgacacgaccggtgctcgatttagcacgtgtcgcaggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggagttataaacttgtctcctggtaccaaacaaacaccccggcaaaagcccccaaaatcatcatttaangagtcactaagcgccgtcggggttactaatcgtcttctctgcctaccaaagtctcggcgacacggcctccngacatctcttgctcacgcngagagagntgtattatttntntnntnatatgnggtagtagtaattatgtgtgtagtaggacgacgtacacgtcgtggtcgacgaccgaacgaccaacccactactcactctctccctaccctcctctactactac

SEQ ID NO: 441994 - DNA, 541 bp, Homo sapiens
  misc_feature: GZ8MTXP02F296V.52.7.A07.1.454.CMB.2.raw
  modified_base (219)..(219): a, c, t, g, unknown or other
  modified_base (416)..(416): a, c, t, g, unknown or other
  modified_base (435)..(435): a, c, t, g, unknown or other
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcacatctctgcgccgaacaanatgatgtggattataacttgtctctgtaccacaacacccgacaacgccccaactcatcattatgagtcactaagcggcccgtcggggtttactactcgtcttctcgtgctcaagtctcggcgaccacggcctccgtagactatctcgttcggcctcgtaggctgacggcgaggctagtatttatttgcttgctcatntggcggttatagttaattntgttctcggaagtggacctacggtcacggtcgtggtacacgcccgaacgacccaccctacgtcgtcctacttccgtccggttccctcccctcctactactactacg

SEQ ID NO: 441995 - DNA, 650 bp, Homo sapiens
  misc_feature: GZ8MTXP02H0G67.52.7.A07.1.454.CMB.2.raw
  modified_base (292)..(292): a, c, t, g, unknown or other
  modified_base (372)..(372): a, c, t, g, unknown or other
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaacaacaatgatgtggattataaacttgtctctggtaccaacaacacccggcaaacgccccaaactcatcatttangaggtcactaagcggccctcggggtttctaatcgcttctctggctccaagtctggcgaccacggcctcctgactatcttntcgctccaggctagaggcgaggctagatttactttttgcttgctcattagtggtacggggttaaagttagtttaaatttagttcggtttacgttccggggaaaggttcgggggtaaccctacggggttacccgtaacccggtccgttacgggggttccaaccgggaccccgaaaccgggtaccccaaaacccccgtaccttacgggttaccctaccgtttccgtcccgtttaccccctaaccccgttcccttaaccctttaacgttaaccgtaaccgg

SEQ ID NO: 441996 - DNA, 735 bp, Homo sapiens
  misc_feature: GZ8MTXP02INJV4.52.7.A07.1.454.CMB.2.raw
  modified_base (172)..(172): a, c, t, g, unknown or other
  modified_base (203)..(203): a, c, t, g, unknown or other
  modified_base (282)..(282): a, c, t, g, unknown or other
tcagcgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgcctggctcaactgcctcgtntctggtctcctggacagtcgatcacatctcngccgccgaacaacatgatgttggattataacttgtctcctgtaccaacaccacccggcaaacgccccaatcatcattangacgtcacgtaacgcggtccgttacggggttactaagtcgtctttcctcgtcggtacctccgtaagttccgtacggtccgtacgaccggtccccttacccgtacggaacctacgttccgttcgtttacgggtccctacccggtagggtaccgtacggaaagggtaccggaggtccgttaggtaactttttaagtttttcggccgtttacggtccttaccgtaacgttagttacgggtaccggggtttaaagttaaacggttttaagtttagttcgggtttacgttaaccggggtaaggttccggggtaaccgtaacggtccgttaaacccgttcggttacggggttacctaccggaaaccccgtacggggtaaccccaaaccccgtcgtaccgttacctacgttccgttaccggttacccctcccgttaccgtttacctacgttaaccgtccg

SEQ ID NO: 441997 - DNA, 567 bp, Homo sapiens
  misc_feature: GZ8MTXP02J0SDO.52.7.A07.1.454.CMB.2.raw
tcagcgcagtacgacacgaccggtgctcgatttagcacgtgtcgcagggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggattataacttgtctcctggtaccaacaacaccccggcaaacgccccaaactcatctattatgagtcactaagcggccctcggggttctaatcgctctctgctccaagtctcggcgacacggcctcctacgacatctacttggcctccaggtctgacggtacgaggctgtatttattttgctgctctatagtgcggtagtagtattatgtcttggaagtcggaacacggtcaccgtcgtggtcacgcccgaaacggaccccaaccccgtacgtaccgtacctaccgtccgttccgttacccccgtccccttacccgtacttaccgtaaccgtcg

SEQ ID NO: 441998 - DNA, 501 bp, Homo sapiens
  misc_feature: GZ8MTXP01D26NW.2.7.A07.1.454.CMB.2.raw
  modified_base (196)..(196): a, c, t, g, unknown or other
  modified_base (262)..(262): a, c, t, g, unknown or other
  modified_base (457)..(457): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaaccnggccaggctcccaggctcctcatctatgctgcatccacagggccactggtatccagccaggttcagtgcagtgggtctgggacagagttcattctcacatcagcagcctgcagtctgaagtatttgactaatttagttactgtcagcagtataataactggtgacgttcggacctaaagggaccaaagggtaaanaaagtacgaaacgaacgttgttacgctagcactattctgttctc

SEQ ID NO: 441999 - DNA, 498 bp, Homo sapiens
  misc_feature: GZ8MTXP01EP0HF.2.7.A07.1.454.CMB.2.raw
  modified_base (196)..(196): a, c, t, g, unknown or other
  modified_base (262)..(262): a, c, t, g, unknown or other
  modified_base (358)..(358): a, c, t, g, unknown or other
  modified_base (481)..(481): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaaccnggccaggctcccaggctcctcatctatgctgcatccacagggccactgtatcccagccaggttcagtggcagtgggtctgggacagagttcattcncaccatcagcagcctgcagtctgaagtatttgactaatttattactgttcagcagtataataactggtggacgttcggcctaaaggggaccaaaggtagaaatacgaaacgacgttgttaggntgcacattctgttcttc

SEQ ID NO: 442000 - DNA, 590 bp, Homo sapiens
  misc_feature: GZ8MTXP01D8RYJ.2.7.A07.1.454.CMB.2.raw
  modified_base (197)..(197): a, c, t, g, unknown or other
  modified_base (211)..(211): a, c, t, g, unknown or other
  modified_base (264)..(264): a, c, t, g, unknown or other
  modified_base (377)..(377): a, c, t, g, unknown or other
  modified_base (408)..(408): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctcttcngcagggccagtcagagtatagcagcaacttagcctggtaccagcaagaaaccnggccaggcctcccgaggcctcctcatctatgctgcactcccacgacgggcccacgtggtactcccgagcctaggttcaggtggcaggtgggtctggggacaggtattcattcncaccatcagcagcctgacagtctagaagttnttttgacttaatttagttaactgtacagtactaagttaattaaataacgttgggtacggtaaccggttcgggaacccgtaaaaggggtaacccttaaaggggttaaaacaaacgtaaaccgaaaacggttacgttggttacggtaactacgaacctaacgtattccgttaacgtttcctaac

SEQ ID NO: 442001 - DNA, 539 bp, Homo sapiens
  misc_feature: GZ8MTXP01D3MCZ.2.7.A07.1.454.CMB.2.raw
  modified_base (262)..(262): a, c, t, g, unknown or other
  modified_base (374)..(374): a, c, t, g, unknown or other
  modified_base (405)..(405): a, c, t, g, unknown or other
  modified_base (487)..(487): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgccaccctctcctgcagggccagtcagagtatagcagcaacttgcctggtaccagcagaaaccnggccaggctcccaggctcctcatctatgctgcatcccaccgagggccacgtggtactcccagccctaggttccaggtggctaggtcgggtctggggacaggtagttcattcncaccatcagcagcctgctagtctagaagttntttagacttaattttagttactgtacagtactaagtataataacgtggtaggtacgttcggacgtaaagggacaaagggtanaaagtacgaaacgttacgttggttacggctgaacctacattctgttcttaac

SEQ ID NO: 442002 - DNA, 536 bp, Homo sapiens
  misc_feature: GZ8MTXP01B8WPO.2.7.A07.1.454.CMB.2.raw
  modified_base (196)..(196): a, c, t, g, unknown or other
  modified_base (263)..(263): a, c, t, g, unknown or other
  modified_base (284)..(284): a, c, t, g, unknown or other
  modified_base (345)..(345): a, c, t, g, unknown or other
  modified_base (362)..(362): a, c, t, g, unknown or other
  modified_base (367)..(367): a, c, t, g, unknown or other
  modified_base (478)..(478): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggctcctnatctatgctgcatcccacagggccactggtactcccagccaggttcagtgcaggtgggtcngggacagagttcattcncaccntcagcagcctgacagtctagaagtatttgacttaaattttagttacttgtcagtctaagttattaaataacgtggtggtaacgttcggacgaaagggaaccaaagggtaanaaagttacgaaacgttacgttggttagggctggccaaccgtattactcgttcgttaac

SEQ ID NO: 442003 - DNA, 517 bp, Homo sapiens
  misc_feature: GZ8MTXP01AWKOM.2.7.A07.1.454.CMB.2.raw
  modified_base (196)..(196): a, c, t, g, unknown or other
  modified_base (206)..(206): a, c, t, g, unknown or other
  modified_base (262)..(262): a, c, t, g, unknown or other
  modified_base (368)..(368): a, c, t, g, unknown or other
tcagacgctcgacacacgaccggtgctcgatttagcacgtgtcgcagggggaggaacagctcagttaggacccagacggaaccatggaagccccagcgcagcttctcttcctcctgctactctggctcccagatgccactggagaagtggtgatgacgcagtctccagccaccctgtctgtgtctccaggggaaanagccaccctntcctgcagggccagtcagagtatagcagcaacttagcctggtaccagcagaaaccnggccaggctcccgaggctcctcatctatgctgcatccacgagggcccacgtggtactcccagccaggttcagtggcaggtgggtctgggacagtacgttcatttcncaccatcagcagcctgcagtctagaatatttgactaatttagtactgtcagctagttataagtaactggtagtacgttcggaccaaaggggaccaaagggtaaagaaacgtaacgaaacgagttgttgctgaacactattctcgttctc

SEQ ID NO: 442004 - DNA, 563 bp, Homo sapiens
  misc_feature: GZ8MTXP01AJDSV.2.7.A07.1.454.CMB.2.raw
  modified_base (426)..(426): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtcctccagccacctgtctgtgtctccgaaggggaaagcgcccaccctctcctgcgagggccagtcagagtatagcagcaacttagcctggtaccagcaagaaacctggccaggcctcccgaggcctcctcatctatgctgcactcccaccgagggcccaacgtggtaacctcccgagccgtaaggttccgaggtggaccaggtcgggtcgtggggacagggtacttcgactttcacaccatcagcagcctgcagtctagaagttntttgacttaatttatactgtacagtctagttaataataacgtgggtacgtacgttcgacgaaagggaccaagggtaacaaagtaccgaaaacgacgttggttacggctcgaactaccattccttaagttccttaacg

SEQ ID NO: 442005 - DNA, 536 bp, Homo sapiens
  misc_feature: GZ8MTXP01AROYA.2.7.A07.1.454.CMB.2.raw
  modified_base (196)..(196): a, c, t, g, unknown or other
  modified_base (261)..(261): a, c, t, g, unknown or other
  modified_base (366)..(366): a, c, t, g, unknown or other
  modified_base (396)..(396): a, c, t, g, unknown or other
  modified_base (483)..(483): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaccnggcaggctccaggctcctcatctatgctgcatcccaccgagggccacgtggtactcccagcctaggttcagtggcaggtgggtctggggactaggagttcattcncaccatcagcagcctgcagtctagaagttntttgacttaatttattactgtacagtctaagttattaagtaacgtgggtacggtacgttcgggaccgaaaggggaaccaagggtaanaaagtacgaaacgacgttggttacggctgaacaccgtattctcgttccttaac

SEQ ID NO: 442006 - DNA, 550 bp, Homo sapiens
  misc_feature: GZ8MTXP01AUHU1.2.7.A07.1.454.CMB.2.raw
  modified_base (196)..(196): a, c, t, g, unknown or other
  modified_base (261)..(261): a, c, t, g, unknown or other
  modified_base (312)..(312): a, c, t, g, unknown or other
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacnggcaggctcccaggctcctcatctatgctgcatccacagggccatggtacnccagccaggttcagtgctaggtgtcgtggacagtacgttctattcacactatcgacgcgacgcctgaccgtagtacgtagtaagttntttacaatttaatttagttacgttgtacacgtatagtaataagttacgtggtacggtacgttccggaacgaaacgggtacttaaagggtaaacaacgtaaacgaacgttaagttgacggtctcgaacctaaccttcttcgtcgttcgtaac

SEQ ID NO: 442007 - DNA, 552 bp, Homo sapiens
  misc_feature: GZ8MTXP01CZT2A.2.7.A07.1.454.CMB.2.raw
  modified_base (199)..(199): a, c, t, g, unknown or other
  modified_base (264)..(264): a, c, t, g, unknown or other
  modified_base (400)..(400): a, c, t, g, unknown or other
  modified_base (487)..(487): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaangccaccctctcctgcagggccagtcagagtatagcagcaaacttgcctggaccagcaagaaaccnggccaggctcccaggcctcctcatctatgctgcatccaccgagggcccaatggtactcccagccaggttcaggtggcaggtgggtctgggacagtagttcattcacaccatcagcagcctgactagtctagaagtntttgacttaatttagtactgtacagactaagtaataaataacgtggtaggtacgttcggaccgtaaaagggaaccaaagggttaaanaaacgtaaacgaaaacgttacgttggttacggtaactacgaaccaactattcgttcgttctaacg

SEQ ID NO: 442008 - DNA, 492 bp, Homo sapiens
  misc_feature: GZ8MTXP01EGB76.2.7.A07.1.454.CMB.2.raw
  modified_base (196)..(196): a, c, t, g, unknown or other
  modified_base (264)..(264): a, c, t, g, unknown or other
  modified_base (357)..(357): a, c, t, g, unknown or other
  modified_base (456)..(456): a, c, t, g, unknown or other
  modified_base (474)..(474): a, c, t, g, unknown or other
  modified_base (476)..(476): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcaagaaaccnggccaggctcccaggctcctcatctatgctgcatccacagggccactgtatcccagccaggtcagtgcagtgggctgggacagagttcattcncaccatcagcagcctgcagtctgaagtatttgataatttatatgtcagcagtataataactggtggtacgttcgggaccaaagggaccaaagggtaaanaaagtacaaagacgttgngntgcacattctgttctc

SEQ ID NO: 442009 - DNA, 560 bp, Homo sapiens
  misc_feature: GZ8MTXP01EWFJ9.2.7.A07.1.454.CMB.2.raw
  modified_base (197)..(197): a, c, t, g, unknown or other
  modified_base (263)..(263): a, c, t, g, unknown or other
  modified_base (320)..(320): a, c, t, g, unknown or other
  modified_base (372)..(372): a, c, t, g, unknown or other
  modified_base (400)..(400): a, c, t, g, unknown or other
  modified_base (426)..(426): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcaagaaccnggccaggctcccaggctcctcatctatgctgcatcccacgagggcccacgtggtacncccagccaggttcaggtggcaggtgggtctggggacaggtagttcatttccncaccatcagcagcctgcagtcagaagtntttgacttaatttagtactgtcagtntaagtaataataacgtgggtcggtaaccgttcgggaccgtaaaggggaaccttaaaggggttaaacaaacgtacgaaaaacggacgttgggttacggcttagaacctaccgtattccgttaagtttccttaacg

SEQ ID NO: 442010 - DNA, 551 bp, Homo sapiens
  misc_feature: GZ8MTXP01EOX2U.2.7.A07.1.454.CMB.2.raw
  modified_base (198)..(198): a, c, t, g, unknown or other
  modified_base (265)..(265): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagcaacttgcctggtaccagcaagaaaccnggccaggcctcccaggcctcctcatctatgctgcactcccaccgacgggccacgtgtactcccagcctaggttcagtggcgtaggtgggtactggggacaggtagttcattcacacctatcagcagcctgacagtcgtagaagttatttagacttaattttagtactgtacagtacaagtataaagtaacgtggtacggtacgtacggacgaaagggtaccttaaaggtagaaaacgtacgaaaacgttagttgttaggctagaactaccattcgtcgttaacttc

SEQ ID NO: 442011 - DNA, 518 bp, Homo sapiens
  misc_feature: GZ8MTXP01DQNWG.2.7.A07.1.454.CMB.2.raw
  modified_base (196)..(196): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggctcctcatctatgctgcatccaccagggcccactggtactcccagccaggttccagtggcaggtgggtctggggacaggagttcattctcaccatcagcagcctgcagtctagaagtatttgactaatttattactgtcagctagtataataactggtggacgttcggctaaaggggaccaaagggtaacgaaattacgaaacgaacttagttcggctagcacctattcttgttcttaac

SEQ ID NO: 442012 - DNA, 521 bp, Homo sapiens
  misc_feature: GZ8MTXP01EXDZ4.2.7.A07.1.454.CMB.2.raw
  modified_base (196)..(196): a, c, t, g, unknown or other
  modified_base (263)..(263): a, c, t, g, unknown or other
  modified_base (282)..(282): a, c, t, g, unknown or other
  modified_base (475)..(475): a, c, t, g, unknown or other
  modified_base (497)..(497): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcaagaaaccnggccaggctccaggctccnatctatgctgcatcccaccagggccactggtactcccagccaggttcagtggcaggtgggtctggggacaggtcgttcatttccacaccatcagcagcctgcagtctagaagtatttgacttaatttacttactgtacagtacaagtataataacgtggtggtacgttcggacgaaagggacttaaagggtanaaatacgaaaacggttattggnggctgccacattctgttcttaacg

SEQ ID NO: 442013 - DNA, 564 bp, Homo sapiens
  misc_feature: GZ8MTXP01DCJMP.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttagcctggtaccagcaagaaacctggccaggcctcccgaggcctcctcatctatgctgcactccccaccgaggggcccacgttcggtactcccgagccctaggttccaggtggctaggtcgggtctggggactagggtagttcattctcaccatcagcagcctgactagtctagaagtatttgacttaaattttagttactgtacagtcaagttataataacgtggtcggtacgttcggaacgaaaggggtaccaaagggtaacaaacgtacgaaacggttacgttggttacggctggaacctaccgtattcctgttccttaac

SEQ ID NO: 442014 - DNA, 615 bp, Homo sapiens
  misc_feature: GZ8MTXP01ENAJ1.2.7.A07.1.454.CMB.2.raw
  modified_base (197)..(197): a, c, t, g, unknown or other
  modified_base (262)..(262): a, c, t, g, unknown or other
  modified_base (282)..(282): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttgcctggtaccagcaagaacnggcaggctccaggcctcctnatctatgctgcactcccgaaccgacggggcccaacgttcgggtaactcccccgaagtcccgtaaggggtttccaaggttgggacctaggggttcggggtcgtgggggaactaggtacgtttcaatttcctacaccctatcgacgcacggcctgacctagtctagaagttatttagacttaatttagtacttgtacagtctaagttataaagttacgtgggtacggtacgttcggaaccgtaaaggggaaccttaaaggggtaaacgaaacgtaacgtaaaacgttacgttggttacggaactaggaacctacgtattcttcgttctttaaccg

SEQ ID NO: 442015 - DNA, 874 bp, Homo sapiens
  misc_feature: GZ8MTXP01D0L6E.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcgagggccagtcagagtatagcagctaacttagcctaggtaccagcaagaaacccgtggacccagggccctaccccgagggtccctccctacattacctatcggtccttcggaccctaaacgtcccccgaacccggacgggggtaccccctacggttacggggttaacctccccccggaaggtacccccgttaaaggggtttccgaacggggttcggggacccgtaaagggggtttcgggggttaccgttaacgggggggaaaccctaaaggggttaccggttttaccctaaacgtttttcccccgtaaacccgaaaccccttaattacccgaaacgggtcccaaacgggtccccctttaggggaacccctaagggttttacccgtaaaggggtaaacggttttaattttttacggaaacccgttttaaaagtttttttacgtttaaacgttcgggtttaaaccctaagggtaaccttaaaggtttaaattaaacggtttaaaccggttgggggttacgggttaaaccccggtttaccgggggaacccgttaaaacgggggaaacccgttaaaaggggtaaacgttaaaacgttaaccgaaaacggttaaccgttgggttacggtaactcgaactacctattccgttaacgttccttaaccg

SEQ ID NO: 442016 - DNA, 533 bp, Homo sapiens
  misc_feature: GZ8MTXP01AS6H0.2.7.A07.1.454.CMB.2.raw
  modified_base (198)..(198): a, c, t, g, unknown or other
  modified_base (263)..(263): a, c, t, g, unknown or other
  modified_base (320)..(320): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanagccaccctctcctgcagggccagtcagagtatagcagcaacttgcctggtaccagcagaaaccngggcaggctcccaggctcctcatctatgctgcatccaccgagggcccacgtggtacncccagcctaggttcaggtggcaggtgggtctggggacaggtagttcattcacaccatcagcagcctgactagtctagaagttattttgacttaatttacgttaactgtacctagctaagtaataagtaacgtggtaggtacgttcgggactaagggaccaaggtaagaaagtacgaaacgacgttgttcggaactgcaccgattctgttcgtc

SEQ ID NO: 442017 - DNA, 537 bp, Homo sapiens
  misc_feature: GZ8MTXP01DBQV7.2.7.A07.1.454.CMB.2.raw
  modified_base (262)..(262): a, c, t, g, unknown or other
  modified_base (283)..(283): a, c, t, g, unknown or other
  modified_base (352)..(352): a, c, t, g, unknown or other
  modified_base (372)..(372): a, c, t, g, unknown or other
  modified_base (402)..(402): a, c, t, g, unknown or other
  modified_base (487)..(487): a, c, t, g, unknown or other
  modified_base (522)..(522): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtatagcagcaacttagcctggtaccagcagaaaccnggccaggctcccaggcctccnatctatgctgcatcccaccgagggcccacgtggtactcccagccctaggttcaggtggcaggtgggtcnggggacaggtagttcattcncaccatcagcagcctgctagtctagaagtnttttgacttaattttatttactgttacagtactaagttaataataacgttgggtagtacgttcggaccgaaagggacaaaggtanaaagtacgaaacgaacgttggttcggctagctacnttacgtgttcttaac

SEQ ID NO: 442018 - DNA, 653 bp, Homo sapiens
  misc_feature: GZ8MTXP01D6UZY.2.7.A07.1.454.CMB.2.raw
  modified_base (197)..(197): a, c, t, g, unknown or other
  modified_base (265)..(265): a, c, t, g, unknown or other
  modified_base (640)..(640): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagctaacttagcctggtaccagcaagaaaccnggaccaggcctacccaggcctcctcatctatcgctgcatcccaccgacggggcccacgttggtaactccccgaagccccgtaaggtttccaggttcgggcctagggttcgggggtaccttgggggaaactagggtacgttttacaacgttttcccaccaaaccctattacccgaaggccaacggcccttggacctaggttactaaggtaaaggttactttttagaacctttaaagttttttacgttaacttggttaccaaggtactaaaggttaaataaagttaaacggtgggtaggtaccggttacggaccgaaaggggaaccttaaagggtaagaaatacgaaaacggttacgttgttacggctagcaacctnttcttcgttctcg

SEQ ID NO: 442019 - DNA, 533 bp, Homo sapiens
  misc_feature: GZ8MTXP01BDHL0.2.7.A07.1.454.CMB.2.raw
  modified_base (196)..(196): a, c, t, g, unknown or other
  modified_base (260)..(260): a, c, t, g, unknown or other
  modified_base (279)..(279): a, c, t, g, unknown or other
  modified_base (361)..(361): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcagaaccnggccaggctccagctcctnatctatgctgcatccacagggccactggtactcccagcctaggttcagtggcaggtgggtctggggacaggtagttcattcncaccatcagcagcctgctagtctagaatattttgacttaattttattacttgtcagtactaagtaataagttaacgtggtacgggtacttccgggacaaaggggtaccaaagggtaagaaacgtacgaaacgaacgttggttacgcgtgaacaaccagttctgttccttaac

SEQ ID NO: 442020 - DNA, 545 bp, Homo sapiens
  misc_feature: GZ8MTXP01C5KZH.2.7.A07.1.454.CMB.2.raw
  modified_base (197)..(197): a, c, t, g, unknown or other
  modified_base (261)..(261): a, c, t, g, unknown or other
  modified_base (281)..(281): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttgcctggtaccagcagaaccnggcaggctcccaggctcctnatctatgctgcatcccaccagggcccacgtggtactccccagccctaggttcagtggctaggtggggtctggggacaggtagttcattctcacatcagcagcctgcagtctagaagtatttgacttaattttattacttgtacagactaagttaataataaacgtggtaggtacgttcgggaccgtaaaggggaccttaaagggtaagaaagtacgaaaacgttacgttggttacggctgccacctattcgttgttcctttaac

SEQ ID NO: 442021 - DNA, 538 bp, Homo sapiens
  misc_feature: GZ8MTXP01EF2U6.2.7.A07.1.454.CMB.2.raw
  modified_base (197)..(197): a, c, t, g, unknown or other
  modified_base (260)..(260): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtgttagcagcaacttgcctggtaccagcagaacnggcaggctccaggctctcatctatgctgcatcccacgagggcccagtggtactcccagcctaggttcagtggctaggtgggtctggggacagggtcgttcatttcacaccatcagcagcctgcagtctgaaagtatttgacttaatttagttactgtacagtcaagttataagttaacgtgggtaggtacgttcgggacctaaaggggaccaaagggggtacaaaagtacgaaaacgttaacgttggttgggctaggccacctattcgtgttcttaac

SEQ ID NO: 442022 - DNA, 537 bp, Homo sapiens
  misc_feature: GZ8MTXP01AKLKK.2.7.A07.1.454.CMB.2.raw
  modified_base (196)..(196): a, c, t, g, unknown or other
  modified_base (364)..(364): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacctggccaggctcccaggctcctcatctatgctgcatcccacagggcccacgtggtactcccagccaggttcagtggcagtgggtctgggacagagttcatttcncaccatcagcagcctgcagtctagaagttatttgactaaattttattactgttacagtcaagttaataagttaaacgttgggtaggtacgtttcggaccgaaaggggaccaaagggtagaaacgtacgaaaacggttacgttggttaggctgctaccagttcctgttcttaac

SEQ ID NO: 442023 - DNA, 516 bp, Homo sapiens
  misc_feature: GZ8MTXP01BSCBX.2.7.A07.1.454.CMB.2.raw
  modified_base (197)..(197): a, c, t, g, unknown or other
  modified_base (206)..(206): a, c, t, g, unknown or other
  modified_base (262)..(262): a, c, t, g, unknown or other
  modified_base (283)..(283): a, c, t, g, unknown or other
  modified_base (362)..(362): a, c, t, g, unknown or other
  modified_base (391)..(391): a, c, t, g, unknown or other
  modified_base (404)..(404): a, c, t, g, unknown or other
  modified_base (463)..(463): a, c, t, g, unknown or other
  modified_base (502)..(502): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctntcctgcagggccagtcagagtatagcagcaacttagcctggtaccagcagaaaccnggccaggctcccaggctcctnatctatgctgcatcccacagggccatggtactcccagccaggttcagtggcaggtgggtctggggacagagttcattcncaccatcagcagcctgcagtctagaagtntttgactaatttntactgtcagtcagtataatacgtggtgacgttcggccaaaggggaccaaaggggtaaanaaacgtacgaaacgttacgttggttcggctgaaccactnttcttcgttcttcg

SEQ ID NO: 442024 - DNA, 526 bp, Homo sapiens
  misc_feature: GZ8MTXP01C92VM.2.7.A07.1.454.CMB.2.raw
  modified_base (265)..(265): a, c, t, g, unknown or other
  modified_base (288)..(288): a, c, t, g, unknown or other
  modified_base (485)..(485): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaaccnggccaggcctcccaggcctcctnatctatgctgcatcccacgacgggccacgtggtactcccagccctaggttccaggtggcaggtcggggtctggggacaggtagtttcattcctacaccatcagcagcctgctagtctagaagtatttgacttaatttattactgtcagtctaagtataataagtggtgtacgtcggacgaaagggacaaagggtaanaaagtacgaacgttacgttgaggctgcacattctgttcttc

SEQ ID NO: 442025 - DNA, 546 bp, Homo sapiens
  misc_feature: GZ8MTXP01BXRI3.2.7.A07.1.454.CMB.2.raw
  modified_base (197)..(197): a, c, t, g, unknown or other
  modified_base (264)..(264): a, c, t, g, unknown or other
  modified_base (417)..(417): a, c, t, g, unknown or other
  modified_base (520)..(520): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcagaaccnggccaggctccaggcctcctcatctatgctgcactcccaccgagggcccacgtggtactcccagcctagggttcaggtggctaggtcgggtctggggacaggtacgttcattctacacctatccagcagccctggaccagttctagaaagttntttagacttaattttagttacttgtacagtctagttaataataacgtggtcgtacgttcggacgaaagggacaaaggtacaaagtacgaaacgacgttgcggntcgaacacctattcctgttccttaac

SEQ ID NO: 442026 - DNA, 528 bp, Homo sapiens
  misc_feature: GZ8MTXP01BOHI7.2.7.A07.1.454.CMB.2.raw
  modified_base (196)..(196): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcagaaaccnggccaggctcccaggctcctcatctatgctgcatcccaccagggccatggtactcccagccaggttcagtgcagtgggtctggggacaggagttcattctcaccatcagcagcctgcagtctgaagtatttgactaatttatactgtcagctagtataataacgtggtcggtacgttcggccgtaaaggggaccaaaggggttaaagaaacgtaacgaaaacggttacgttggttacggctacgaaccacctattccgtgttccttc

SEQ ID NO: 442027 - DNA, 516 bp, Homo sapiens
  misc_feature: GZ8MTXP01BBEQU.2.7.A07.1.454.CMB.2.raw
  modified_base (196)..(196): a, c, t, g, unknown or other
  modified_base (362)..(362): a, c, t, g, unknown or other
  modified_base (392)..(392): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggcctcccaggctcctcatctatgctgcatccaccagggccactggtactcccagccaggttcagtgcaggtgggctgggacagagttcattcncaccatcagcagcctagcagtctagaagtnttttgactaatttagttactgtcagtcagtaataataacgtggtagtacgttcggaccgaaagggaccaaagggtagaaatacgaaacgacgttggttaggctgctaccattctgttcttaacc

SEQ ID NO: 442028 - DNA, 495 bp, Homo sapiens
  misc_feature: GZ8MTXP01C33L4.2.7.A07.1.454.CMB.2.raw
  modified_base (197)..(197): a, c, t, g, unknown or other
  modified_base (262)..(262): a, c, t, g, unknown or other
  modified_base (283)..(283): a, c, t, g, unknown or other
  modified_base (461)..(461): a, c, t, g, unknown or other
  modified_base (476)..(476): a, c, t, g, unknown or other
  modified_base (478)..(478): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaangccaccctctcctgcagggccagtcagagtatagcagcaacttagcctggtaccagcagaaaccnggccaggctcccaggctcctnatctatgctgcatccacagggccactggtatcccagccaggttcagtggcagtgggtctgggacagagttcattctcaccatcagcagcctggctagtctagaagtatttgacttaattttattactgttaccagcaagttataataacgtggtgacgttcggcaagggacaaggtanaatacgaagacttgngntgcacattctgttcttc

SEQ ID NO: 442029 - DNA, 577 bp, Homo sapiens
  misc_feature: GZ8MTXP01DWBJM.2.7.A07.1.454.CMB.2.raw
  modified_base (200)..(200): a, c, t, g, unknown or other
  modified_base (269)..(269): a, c, t, g, unknown or other
  modified_base (514)..(514): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaagggggaaanacgcccaccctctcctgcagggccagtcagagtatagcagcaacttagcctggtaccagcaagaaaccnggccaggcctcccgaggcctcctcatctatgctgcactccaccgagggcccacgtggtactcccgagcctaggttcagtggctaggtcgggtctggggactaggtagttcagttcctacaccatcagtcagcctgactagtctaggaagttatttgacttaaatttattacgtgttacagtactaagttaataagtaacgtgggtacgtacggttacggaccgtaaagggtaaccaaagggttanaaagtacgaaaacgttacgttggttacggtctacgaactaccgattcctcggttctttaaccg

SEQ ID NO: 442030 - DNA, 517 bp, Homo sapiens
  misc_feature: GZ8MTXP01DZBZ1.2.7.A07.1.454.CMB.2.raw
  modified_base (196)..(196): a, c, t, g, unknown or other
  modified_base (263)..(263): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggctcctcatctatgctgcatcccaccagggccacgtggtactcccagccaggttcagtgcaggtgggtctggggacagagttcattcncaccatcagcagcctgcagtctagaagtatttgacttaatttagttactgtacagctaagtataattaacgtgggtaggtacgttcggaccgaaagggaaccaaaggtaagaaatacgaaacgacgttgttaggctgcacattctgttcttc

SEQ ID NO: 442031 - DNA, 588 bp, Homo sapiens
  misc_feature: GZ8MTXP01DS7X5.2.7.A07.1.454.CMB.2.raw
  modified_base (197)..(197): a, c, t, g, unknown or other
  modified_base (265)..(265): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaaccnggccaggctcccaggctcctnatctatgctgcatcccaccagggcccacgtggtactcccagccaggttcaggtggctaggtgggtctggggacagtagttcattctcaccatcagcagcctgctagtctagaagttatttgacttaattttattaacttgtacagtactaagttaattaagttaaacgtgggttaggtaaccggtttcgggacccgtaaaaggggtaacccaaagggttaaacgaaaacgttaccgaaaaacggttaacgttggttacggccttacggaacctaaccctagttccttcgttcctttaacccg

SEQ ID NO: 442032 - DNA, 535 bp, Homo sapiens
  misc_feature: GZ8MTXP01BJZR9.2.7.A07.1.454.CMB.2.raw
  modified_base (196)..(196): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggcctcctcatctatgctgcactcccacgagggccacgtggtactcccagcctaggttcagtggcaggtgggtctggggacaggtagttcattcacaccatcagcagcctgctagtctagaagttatttgacttaatttagttactgtacagtctaagttaataataacgtggtacgggtacttcggaccgaaaggggaaccaaagggtacaaagtacgaaacggacgttggttaggctgcactattctcgttcttaac

SEQ ID NO: 442033 - DNA, 510 bp, Homo sapiens
  misc_feature: GZ8MTXP01AB565.2.7.A07.1.454.CMB.2.raw
  modified_base (196)..(196): a, c, t, g, unknown or other
  modified_base (206)..(206): a, c, t, g, unknown or other
  modified_base (263)..(263): a, c, t, g, unknown or other
  modified_base (279)..(279): a, c, t, g, unknown or other
  modified_base (361)..(361): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctntcctgcagggccagtcagagtattagcagcaacttagcctggtaccagcagaaaccnggcagctccagctccnatctatgctgcatcccacagggcccactggtactcccagcctaggttcagtggcaggtgggtctgggacagtagttcattcncaccatcagcagcctgcagtctagaagtatttgacttaatttagttactgtcagtcagttataataacgtggtgtacgttcggctaaagggaccaaaggtagaaatacgaaacgttagttggttggctgaacaccattctgttcttaac

SEQ ID NO: 442034 - DNA, 558 bp, Homo sapiens
  misc_feature: GZ8MTXP01EWPNN.2.7.A07.1.454.CMB.2.raw
  modified_base (197)..(197): a, c, t, g, unknown or other
  modified_base (512)..(512): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagcaacttagcctggtaccagcaagaaacctggaccaggcctacccgaggcctcctcatctatgctgcactcccacgacgggccaacgtggtactcccagcctaggttcaggtggcaggtggggtctggggacaggtgttcatttcacacctatcagcagcctgctagtcagtaagtattttgaacttaattttacgttacttgtactagactaagttaattaaagtaacgtgggtacggtacgttcggaaccgaaaggggaaccttaaagggtaanaaactacgaaaagacgttggaggctagctaccattctgttcttaac

SEQ ID NO: 442035 - DNA, 557 bp, Homo sapiens
  misc_feature: GZ8MTXP01BPYL4.2.7.A07.1.454.CMB.2.raw
  modified_base (197)..(197): a, c, t, g, unknown or other
  modified_base (265)..(265): a, c, t, g, unknown or other
  modified_base (288)..(288): a, c, t, g, unknown or other
  modified_base (375)..(375): a, c, t, g, unknown or other
  modified_base (380)..(380): a, c, t, g, unknown or other
  modified_base (406)..(406): a, c, t, g, unknown or other
  modified_base (495)..(495): a, c, t, g, unknown or other
  modified_base (541)..(541): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaaccnggccaggcctcccaggcctcctnatctatgctgcatcccacgagggcccacgtggtactcccagcctaggttcagtggcaggtgggtctggggacaggtagttcatttcncaccntcagcagcctgctagtctagaagttntttgacttaatttagttactggtacagctagtaataataacgtgggtacgtacgttcgggacccaaaagggggtaccaaaggggtaaanaaacgtacgaaaacgttacgttggttaggtaactagaacctaactnttccgtcgttcctaac

SEQ ID NO: 442036 - DNA, 529 bp, Homo sapiens
  misc_feature: GZ8MTXP01DY4H5.2.7.A07.1.454.CMB.2.raw
  modified_base (197)..(197): a, c, t, g, unknown or other
  modified_base (406)..(406): a, c, t, g, unknown or other
  modified_base (481)..(481): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcaagaaacctggccaggcctcccaggctcctcatctatgctgcatcccaccgagggccacgtggtactcccagccaggttcagtggcaggtcgggtctggggactaggacgtttcattctcaaccatcagcagcctgctagtctagaatntttgactaatttatactgtacagctagtataataacgtgggtagtacgttcgggaccaaagggacaaagggtaanaaagtacgaaacgagttggttaggctgaacacgattctgttcttaacc

SEQ ID NO: 442037 - DNA, 525 bp, Homo sapiens
  misc_feature: GZ8MTXP01A5XUP.2.7.A07.1.454.CMB.2.raw
  modified_base (197)..(197): a, c, t, g, unknown or other
  modified_base (263)..(263): a, c, t, g, unknown or other
  modified_base (284)..(284): a, c, t, g, unknown or other
  modified_base (356)..(356): a, c, t, g, unknown or other
  modified_base (392)..(392): a, c, t, g, unknown or other
  modified_base (406)..(406): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttagcctggtaccagcagaaaccnggccaggctcccaggctcctnatctatgctgcatccaccgagggccacgtggactcccagccaggttcagtggcaggtgggtctggggacagngttcattcacacatcagcagcctgcagtcagaagtntttgacttaatttnttactgtacagtctaagtataatacgtggtaggtacgttcggaccaaaggggtaccaaagggtacaaagtacgaaacgttacgttggttacggctcgcctacagttctcgttcgttaac

SEQ ID NO: 442038 - DNA, 511 bp, Homo sapiens
  misc_feature: GZ8MTXP01ANVPI.2.7.A07.1.454.CMB.2.raw
  modified_base (196)..(196): a, c, t, g, unknown or other
  modified_base (205)..(205): a, c, t, g, unknown or other
  modified_base (261)..(261): a, c, t, g, unknown or other
  modified_base (346)..(346): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctntcctgcagggccagtcagagtatagcagcaacttagcctggtaccagcagaaaccnggccaggctcccaggctctcatctatgctgcatccacagggccactggtatcccagccaggttcagtggcagtgggtctgggacngagttcattctcaccatcagcagcctgcagtctgaagtattttgactaatttattactgtcagtcagtataataacgtggtgacgttcgggcaaaggggccaaagggtacgaaatcgaaaacgttacgttgttcgggaacttggccacctattcctgttcttaac

SEQ ID NO: 442039 - DNA, 515 bp, Homo sapiens
  misc_feature: GZ8MTXP01AUPAF.2.7.A07.1.454.CMB.2.raw
  modified_base (196)..(196): a, c, t, g, unknown or other
  modified_base (284)..(284): a, c, t, g, unknown or other
  modified_base (389)..(389): a, c, t, g, unknown or other
  modified_base (469)..(469): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcaagaaacctggccaggctcccaggcctcctnatctatgctgcatcccacagggccagtgactccagccaggttcagtgcaggtgggctgggacaggtagttcatttcacaccatcagcagcctgcagtcagaagtntttgacttaatttattactgtcagactaagtaataagtaacgtggtaggtacgttcggacgaaaggggacaaagggtaanaaactacgaaacgacgttgaggctgaacacctattcgtcgttcttc

SEQ ID NO: 442040 - DNA, 602 bp, Homo sapiens
  misc_feature: GZ8MTXP01EUNFQ.2.7.A07.1.454.CMB.2.raw
  modified_base (197)..(197): a, c, t, g, unknown or other
  modified_base (421)..(421): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttgcctggtaccagcagaaacctggccaggcctcccaggcctcctcatctatgctgcactcccaccgagggccctaacgtggtactcccgagccctaggttccaggtggctagggtgggtctgggggactagggtacgtttcagtttcacaccctatcagcagcctgactagtctagaagtnttttgacttaatttattacttgtacagtactaagttaattaagttaacgtggggttacggtaccggtttacgggacccggtaaaaggggtaaccgttaaaggggttaacgaaaacgtacgaaaacggttaacgttggttacggcttagaaccctaactacgttcttcggttcctttaaccg

SEQ ID NO: 442041 - DNA, 546 bp, Homo sapiens
  misc_feature: GZ8MTXP01B6ZY4.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggcccacgtggtactccccgagccctaggttcaggtggcaggttggggtctggggactaggtagtttcatttcctcaccatcagcagcctgccagtctgaagtatttgacttaattttattacttgtacagtctaagttaactaattaacgtgggtggaccgttcgggaccgtaaagggaccaaagggtacgaaatacgaaacgttacgttggttagctagcaccattcctgttcctttaac

SEQ ID NO: 442042 - DNA, 543 bp, Homo sapiens
  misc_feature: GZ8MTXP01CBO4Z.2.7.A07.1.454.CMB.2.raw
  modified_base (197)..(197): a, c, t, g, unknown or other
  modified_base (294)..(294): a, c, t, g, unknown or other
  modified_base (415)..(415): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagacagaaacctggccaggcctcccaggcctcctcatctangcctgcatccaccagggccacgtggtactcccagccgacggttcaggtggcaggtgggtctggggactagggtagttcatttctcaacccatccaagcagtcctgactagtctagtaagtnttttgacttaattttagttactgtacagactaagtataattacgtggtaggtacgttcggacgtaaagggacaaaggtacaaagtacgaaacgacgttggttacgctagcactgttctcgttcttaac

SEQ ID NO: 442043 - DNA, 533 bp, Homo sapiens
  misc_feature: GZ8MTXP01DIZYI.2.7.A07.1.454.CMB.2.raw
  modified_base (196)..(196): a, c, t, g, unknown or other
  modified_base (262)..(262): a, c, t, g, unknown or other
  modified_base (284)..(284): a, c, t, g, unknown or other
  modified_base (365)..(365): a, c, t, g, unknown or other
  modified_base (479)..(479): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttagcctggtaccagcagaaaccnggccaggctcccaggcctcctnatctatgctgcatcccacagggccacgtggtactcccagccaggttcagtggcaggtgggtctgggacagtagttcattcncaccatcagcagcctgctagtctagaagtatttgacttaatttattactgtacagtactagtataagtaacgtgggtaggtacgttcggaccgaaagggaccttaaagggtaanaaaacgtacgaaaacgacgttggttacggctagccacctattcctgttcttaac

SEQ ID NO: 442044 - DNA, 522 bp, Homo sapiens
  misc_feature: GZ8MTXP01DZIIP.2.7.A07.1.454.CMB.2.raw
  modified_base (199)..(199): a, c, t, g, unknown or other
  modified_base (268)..(268): a, c, t, g, unknown or other
  modified_base (286)..(286): a, c, t, g, unknown or other
  modified_base (315)..(315): a, c, t, g, unknown or other
  modified_base (361)..(361): a, c, t, g, unknown or other
  modified_base (415)..(415): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanacgccaccctctcctgcagggccagtcagagtattagcagcaacttagcctggtaccagcaagaaaccnggccagctccagctcctnatctatgctgcatccacagggccatgacnccagccaggttcagtggcaggtgggtctggggacagagttcattcncacatcagcagcctgacagtctaggaatatttgataattttattactgtacagntaagttaataaataaacgtgggtaggtacgttcggaccgaaagggaccaaagggtaaagaaagtacgaaacgacgttggttgctagaacactacttactcgttcgtc

SEQ ID NO: 442045 - DNA, 562 bp, Homo sapiens
  misc_feature: GZ8MTXP01BXPAU.2.7.A07.1.454.CMB.2.raw
  modified_base (287)..(287): a, c, t, g, unknown or other
  modified_base (415)..(415): a, c, t, g, unknown or other
  modified_base (429)..(429): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggctcccgaggctcctnatctatgctgcatcccaccgagggcccactcggtactccccgagcctaggttcaggtggctaggtcgggctggggacaggtacgtttcagttcctcaccctatccagcagcctgactagtctgaagtntttgacttaatttntactgtacagtctaagtaattaaagtacgtgggtacggtacgttacggaccgaaaggggtaccaaagggtaagaaactacgaaaacgttaacgttggttcggctaggcctaccgtattcctgttcctttaacg

SEQ ID NO: 442046 - DNA, 503 bp, Homo sapiens
  misc_feature: GZ8MTXP01DHG0W.2.7.A07.1.454.CMB.2.raw
  modified_base (198)..(198): a, c, t, g, unknown or other
  modified_base (264)..(264): a, c, t, g, unknown or other
  modified_base (284)..(284): a, c, t, g, unknown or other
  modified_base (347)..(347): a, c, t, g, unknown or other
  modified_base (356)..(356): a, c, t, g, unknown or other
  modified_base (369)..(371): a, c, t, g, unknown or other
  modified_base (373)..(373): a, c, t, g, unknown or other
  modified_base (376)..(376): a, c, t, g, unknown or other
  modified_base (399)..(399): a, c, t, g, unknown or other
  modified_base (401)..(401): a, c, t, g, unknown or other
  modified_base (480)..(480): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccatggagaagtggtgatgacgcagtctccagccaccctgtctgtgtctaccgaagggggaaanagcccacctctcctgcagggccagtcagagtattagcagcaattagcctggtaccagcaagaaacnggccagctcccaggctcctnatctatgctgcatccacagggccactgactccagccagttcagtgcaggtggtctgggacagngttcattcncacatcagcagcnnntntanagtattatataattattatgtananatagtaataataagtaggtggtacgtacggacgaaggaacgaaaggtaaagaaagtaaacgtaaacgaacgttgttagngtgaacactacttctcgttcgtc

SEQ ID NO: 442047 - DNA, 539 bp, Homo sapiens
  misc_feature: GZ8MTXP01ETVXV.2.7.A07.1.454.CMB.2.raw
  modified_base (197)..(197): a, c, t, g, unknown or other
  modified_base (263)..(263): a, c, t, g, unknown or other
  modified_base (369)..(369): a, c, t, g, unknown or other
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaaccnggccaggctcccaggcctcctcatctatgctgcatcccacagggccacgtggtactcccagccaggttcagtggcaggtgggtctggggacaggtagttcatttcncaccatcagcagcctgcagttcagtaagtnttttgacttaattttacttacttgtcaggtactaagttaactaagttaacgtgggtacgtacgttcggacgaaagggtaccaaagggtaacaaagtacgaaacgttacgttggttaggctgaacacctattctgttctcc

SEQ ID NO: 442048 - DNA, 530 bp, Homo sapiens
  misc_feature: GZ8MTXP01CTSYX.2.7.A07.1.454.CMB.2.raw
  modified_base (197)..(197): a, c, t, g, unknown or other
  modified_base (262)..(262): a, c, t, g, unknown or other
  modified_base (283)..(283): a, c, t, g, unknown or other
  modified_base (365)..(365): a, c, t, g, unknown or other
  modified_base (394)..(394): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaaccnggccaggctcccaggctcctnatctatgctgcatccacgagggcccactggtactcccagccaggttcagtggctaggtgggtctgggacaggagttcattcncacatcagcagcctgcagtctagtaagtntttgacttaaattttagttactgtacagtctaagtataataacgtggtacgacgttcggactaaaggggaccaaagggtaacaaagtacgaaacgttaacgttggttaggcctgaacctacgattctgttcttaac

SEQ ID NO: 442049 - DNA, 538 bp, Homo sapiens
  misc_feature: GZ8MTXP01EB4FN.2.7.A07.1.454.CMB.2.raw
  modified_base (263)..(263): a, c, t, g, unknown or other
  modified_base (377)..(377): a, c, t, g, unknown or other
  modified_base (492)..(492): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgccaccctctcctgcagggccagtcagagtatagcagcaacttgcctggtaccagcaagaaaccnggccaggctcccaggcctcctcatctatgctgcatccaccgagggcccacgtggtactcccagcctaggttcaggtggctaggtgggtctgggggactaggtagttcatttccncaccatcagcagcctgactagtctaggaattatttgacttaattttatactgtacagtactaagtaattaagtaacgtggtaggtacgttcgggacgaaagggacaaagggtaanaaatacgaaacgattggttagctagaacaccgtattcttgttcttc

SEQ ID NO: 442050 - DNA, 566 bp, Homo sapiens
  misc_feature: GZ8MTXP01C0J7O.2.7.A07.1.454.CMB.2.raw
  modified_base (198)..(198): a, c, t, g, unknown or other
  modified_base (291)..(291): a, c, t, g, unknown or other
  modified_base (374)..(374): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctaggtaccagcaagaaacctggaccaggcctcccaggcctcctnatctatgctgcatcccacgagggccacgtggactcccagcctaggttcaggtggctaggtgggtctgggacagagttcattcncactatcagcagcctggactagtctagtaagtactttgacttaaatttattactgtacagtctaagtataagtaacgtggtacggtacgttcggaacgtaaagggaaccaaagggtaaacaaagttaacgaaacgttaaacgttggttacggtctacggcctaaccgtattccgttaacgttcctttaaccg

SEQ ID NO: 442051 - DNA, 523 bp, Homo sapiens
  misc_feature: GZ8MTXP01C0XIE.2.7.A07.1.454.CMB.2.raw
  modified_base (198)..(198): a, c, t, g, unknown or other
  modified_base (261)..(261): a, c, t, g, unknown or other
  modified_base (279)..(279): a, c, t, g, unknown or other
  modified_base (341)..(341): a, c, t, g, unknown or other
  modified_base (358)..(358): a, c, t, g, unknown or other
  modified_base (388)..(388): a, c, t, g, unknown or other
  modified_base (523)..(523): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtatagcagcaacttgcctggtaccagcagaacnggcaggctccaggctccnatctatgctgcatcccacgagggccatggtactcccagccaggttcagtggcaggtgggtcngggacaggattcattcncaccatcagcagcctgctagtctagaagtntttgacttaaatttattaactgtacagtctaagtaataattaaacgtggtacggtacgttcggaccgaaaggggtaccaaagggttaagaaagttaacgaaacgaacgttgttaggctgcacattcgttgttctn

SEQ ID NO: 442052 - DNA, 567 bp, Homo sapiens
  misc_feature: GZ8MTXP01C7848.2.7.A07.1.454.CMB.2.raw
  modified_base (194)..(194): a, c, t, g, unknown or other
  modified_base (228)..(228): a, c, t, g, unknown or other
  modified_base (254)..(254): a, c, t, g, unknown or other
  modified_base (274)..(274): a, c, t, g, unknown or other
  modified_base (402)..(402): a, c, t, g, unknown or other
tcagacgctcgacacacgaccggtgctcgatttagcacgtgtcgcgagggggagaactgctcagttaggacccagacggaaccatggaagccccagcgcagcttctcttcctcctgctactctggctccagatgccactggagaagtggtgatgacgcagtctccagccacctgtctgtgtctcgaagggaaancgccacctctctgcagggccagtcagagtatagnagctaattgctggacagcaagaaacnggcaggctaccaggctcctnatctatcgctgcatcccaacgagggccaacgtggtactccccgagcctaaggttcaggtggcaggtgggtctgggactagggtattcatttcacaccatcagccagcctgactagtctagaaagtttntttagacttaatttagtacgtagtacagtagtaagtaagtaagttaacgtaggtacggtacggtaccggtaacggtaacggtaaacgttaaacggtaaacgttaaacgtaaacgtaaacgttaacgttacgttacgtcgtacgaacactacttacttcgttcgtc

SEQ ID NO: 442053 - DNA, 556 bp, Homo sapiens
  misc_feature: GZ8MTXP01CM0RV.2.7.A07.1.454.CMB.2.raw
  modified_base (199)..(199): a, c, t, g, unknown or other
  modified_base (265)..(265): a, c, t, g, unknown or other
  modified_base (286)..(286): a, c, t, g, unknown or other
  modified_base (505)..(505): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanagccaccctctcctgcagggccagtcagagtatagcagcaacttagcctggtaccagcaagaaccnggccaggctcccaggctcctnatcatgctgcatcccacgagggcccagtggtactccccgagcccgtaggtttccaggtcggctaggtcggggtctggggacctagggtacgttccattcctcaaccatcaagtcagccctgactagtctaggaatattttgacttaaattttacttactgttacagtactaagtaactagttaacgtggtacgacgttcggacgaagggacaaaggtanaaatacgaaacgttacgttgttacggctagccactattcgtgttcgttaac

SEQ ID NO: 442054 - DNA, 527 bp, Homo sapiens
  misc_feature: GZ8MTXP01B9REQ.2.7.A07.1.454.CMB.2.raw
  modified_base (197)..(197): a, c, t, g, unknown or other
  modified_base (207)..(207): a, c, t, g, unknown or other
  modified_base (263)..(263): a, c, t, g, unknown or other
  modified_base (363)..(363): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctntcctgcagggccagtcagagtatagcagcaacttagcctggtaccagcagaaaccnggccaggctcccaggctcctcatctatgctgcatcccacagggccactggactcccagccaggttcagtggcaggtgggtctgggacagtagttcattcnaccatcagcagcctgacagtctagaagtatttgactaaattttagttactgtcagtactagtataataacgtggtaggacgttcggccgaaagggaccaaaggtaacgaaatacgaaacgttaacgttggttacggctagcctaccattcgtaacgttcttaac

SEQ ID NO: 442055 - DNA, 526 bp, Homo sapiens
  misc_feature: GZ8MTXP01AKYS9.2.7.A07.1.454.CMB.2.raw
  modified_base (196)..(196): a, c, t, g, unknown or other
  modified_base (262)..(262): a, c, t, g, unknown or other
  modified_base (371)..(371): a, c, t, g, unknown or other
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaaccnggccaggctcccaggctcctcatctatgctgcatcccaccgagggcccacgtggtactccccgagccaggttcaggtggcaggtgggtctggggacagagttcatttcncaccatcagcagcctgcagtctagaagtntttgacttaatttattactgtcagcagtataatacgtggtaggtacgttcggccgtaaagggaccttaaagggtagaaagttacgaaaacggttacgttggttaggctagcaccattctgttcttc

SEQ ID NO: 442056 - DNA, 581 bp, Homo sapiens
  misc_feature: GZ8MTXP01CMFLN.2.7.A07.1.454.CMB.2.raw
  modified_base (197)..(197): a, c, t, g, unknown or other
  modified_base (262)..(262): a, c, t, g, unknown or other
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaccnggccaggctcccgaggctcctnatctatcgctgcatcccaccgagggcccagtggtactcccagccaggttcaggtggcaggtgggtctgggacagagttcattctcaccatcagcagcctgcagtctagaagttactttgacttaattttacttacttggtcaagtactaagttaataaagttaacgtggggttacgtacggttaccgggaaccgaaacggggtaaccttaaagggggttaaacaaaacgttaacgaaaacggttaacgttgggttacgggtaactacggaactaacccgtattcctgttccttaacc

SEQ ID NO: 442057 - DNA, 529 bp, Homo sapiens
  misc_feature: GZ8MTXP01APVWG.2.7.A07.1.454.CMB.2.raw
  modified_base (196)..(196): a, c, t, g, unknown or other
  modified_base (262)..(262): a, c, t, g, unknown or other
  modified_base (393)..(393): a, c, t, g, unknown or other
  modified_base (472)..(472): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaaccnggccaggctcccaggctcctcatctatgctgcatccacagggcccactggtactcccagccaggttcaggtggcaggtgggtctggggacagtagttcattctcaccatcagcagcctgcagtctgaagtnttttgacttaatttattactgtcagctaagtataaataacgtggtggacgttcggaccaaggtcgaacgtaaggttaanaaactaacgaaacgttacttggtaacggctaacggcctacgttacttcgttcgttcc

SEQ ID NO: 442058 - DNA, 543 bp, Homo sapiens
  misc_feature: GZ8MTXP01DU6XS.2.7.A07.1.454.CMB.2.raw
  modified_base (197)..(197): a, c, t, g, unknown or other
  modified_base (262)..(262): a, c, t, g, unknown or other
  modified_base (282)..(282): a, c, t, g, unknown or other
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaaccnggccaggctccaggctcctnatctatgctgcatcccacacgggccacgtggtactcccgagcctaggttcaggtggcaggtgggtctggggacaggtagttcattctcaccatcagcagcctgctagtctagaagttntttgacttaaattttattacttgtactagctaaagttataaagttaacgtgggtaggtacgttacgggacgaaagggtaccaaaggttaagaaagtacgaaacgttacgttggttaggctgaacctacgattcgtgttccttc

SEQ ID NO: 442059 - DNA, 516 bp, Homo sapiens
  misc_feature: GZ8MTXP01C7FNB.2.7.A07.1.454.CMB.2.raw
  modified_base (195)..(195): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaanagccaccctctcctgcagggccagtcagagtattagcagcaacttagcctggtaccagcagaaacctggccaggctcccaggctcctcatctatgctgcatccaccagggcccacgtggtactcccagccaggttcagtggcaggtgggtctggggacaggtagttcattctcaccatcagcagcctgcagtctagaagtatttgacttaatttattactgtacagtcagtataagtaactggtgtacggtcggacaaagggaccaaaggtaagaaagtacgaaacgacgttggttaggctgcaccattctcgttcttaac

SEQ ID NO: 442060 - DNA, 545 bp, Homo sapiens
  misc_feature: GZ8MTXP01BVG5S.2.7.A07.1.454.CMB.2.raw
  modified_base (197)..(197): a, c, t, g, unknown or other
  modified_base (266)..(266): a, c, t, g, unknown or other
  modified_base (287)..(287): a, c, t, g, unknown or other
  modified_base (376)..(376): a, c, t, g, unknown or other
  modified_base (381)..(381): a, c, t, g, unknown or other
  modified_base (406)..(406): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtattagcagcaacttagcctggtaccagcagaaaccnggccaggctcccaggctcctnatctatgctgcatcccaccgagggcccagtggtactcccagcctaggttcaggtggcaggtcgggtctggggacaggacgttcatttcncaccntcagcagcctgctagtctagaagtntttgacttaatttagtactgtacagtctaagtactaagtaacgtgggtacggtacgttacggccgaaaggggtaccaaagggtacgaaatacgaaacgttacgttggttaggaactcggaactaccgattctgttcttc

SEQ ID NO: 442061 - DNA, 618 bp, Homo sapiens
  misc_feature: GZ8MTXP01BFPCK.2.7.A07.1.454.CMB.2.raw
  modified_base (197)..(197): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagcaagaaccnggccaggctccaggctcctcatctatcgctgcactcccaccgagggccacgtggtactcccgagcccgtaggttccaggtcggcgtaggtcggggtctggggactagggtactttcatttccacaacccatacaggcagcctaggcctagtctaggaaattattttagacttaaattttattaacgtggttactaaggttaagtaacttaaagttaacgtgggttacggtaccggtttacgggacccgtaaaggggtaacctaaaggggttaaacgaaaacgttaccgaaaacggtaacgttgggttacggccttaaggacctaacgtacttccgttagttcctttcgtaaccg

SEQ ID NO: 442062 - DNA, 594 bp, Homo sapiens
  misc_feature: GZ8MTXP01DASQI.2.7.A07.1.454.CMB.2.raw
  modified_base (195)..(195): a, c, t, g, unknown or other
  modified_base (263)..(263): a, c, t, g, unknown or other
  modified_base (325)..(325): a, c, t, g, unknown or other
  modified_base (408)..(408): a, c, t, g, unknown or other
  modified_base (418)..(418): a, c, t, g, unknown or other
  modified_base (577)..(577): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctccagatgccactggagaagtggtgatgacgcagtctccagccacctgtctgtgtctccgaaggggaaanacgcccaccctctcctgcagggccagtcagagtatagcagcaacttgcctaggaccagcaagaaaccnggaccaggcctacccgaggcctcctcatctatgctgcactccaccgagggccacgtggtacncccgagcctaggttcaggtggcaggtgggtcgtggggactaggtagttcattctacaacctatcgaagcacgcctgactagtntagaaagttnttttagacttaaattttagttactgtacaagtactaaagttaattaaagtaacggttgggtaacgggtacccgttacgggaaccgtaaaaggggaacccttaaaggggtaaaagaaacgtaaacgaaaacgttacgttggacgctacgaacctaacgtnttcctttgttccttaac

SEQ ID NO: 442063 - DNA, 550 bp, Homo sapiens
  misc_feature: GZ8MTXP01AI3GA.2.7.A07.1.454.CMB.2.raw
  modified_base (197)..(197): a, c, t, g, unknown or other
  modified_base (265)..(265): a, c, t, g, unknown or other
  modified_base (381)..(381): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcagaaaccnggccaggctcccaggcctcctcatctatcgctgcactcccaccagggcccacgtggactccagccaggttcagtggcaggtgggtctgggacaggtattcattcacacatcagtancctgcagttctagaagtatttgactaatttatacgtgtacagactaagtataagtagttgggtacggtacgttacggaccgaaagggtaaccaaagggttaagaaacttacgaaaacgtaacttgggttcggactggacctaacagttcttacgttccgtttctaaccg

SEQ ID NO: 442064 - DNA, 616 bp, Homo sapiens
  misc_feature: GZ8MTXP01AOY24.2.7.A07.1.454.CMB.2.raw
  modified_base (197)..(197): a, c, t, g, unknown or other
  modified_base (260)..(260): a, c, t, g, unknown or other
  modified_base (279)..(279): a, c, t, g, unknown or other
  modified_base (289)..(289): a, c, t, g, unknown or other
  modified_base (295)..(295): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaangccacctctcctgcagggccagtcagagtatagcagcaacttagcctggtaccagcagaaccnggccaggctccaggcctcnatctatgctnactacnccgacggacggcctacggtgtacctccgacgtccgtacggttcgaggtcggcgtaggggtcgggtgtcgggacgtaggttacgttctacgttccaccgtaactactacgacgtacgacgtcctagtaccgtagttcgtaaggtaagtttatttacgtaacttttaatttacggttcgtagttacgacgtataagtaattaagttaacggtgggttaccggtacggttaccggaacggaaggtaacgttaaaggtaacaaacgtaacgtaaacggttagttcggttacgctacgaacctactacgttcgtccgttcttaacg

SEQ ID NO: 442065 - DNA, 624 bp, Homo sapiens
  misc_feature: GZ8MTXP01EK4NH.2.7.A07.1.454.CMB.2.raw
  modified_base (196)..(196): a, c, t, g, unknown or other
  modified_base (262)..(262): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttagcctggtaccagcaagaaccnggccaggcctacccgaggctcctnatctatgctgcactcccaccgagggccctacgtcgtactcccgagcctaggttccaggtggcgtaggtcgggtacgtggggactagggtacgtttcacgttctacacctatcaggccacggcccttagaccgtagttaccgtaggtaaacgttgttttacgaatttaaacttttacgttacttaggtacctaggtactaagttattaaagttacgtgggtacggtacgttacgggaccgtaaaaggggtaaccttaaagggtaaaccgttaaagtaaccgtaaaacgttacggttggaccggtaactacgaactacctattacgtcgttcttaacccg

SEQ ID NO: 442066 - DNA, 582 bp, Homo sapiens
  misc_feature: GZ8MTXP01CJUH9.2.7.A07.1.454.CMB.2.raw
  modified_base (198)..(198): a, c, t, g, unknown or other
  modified_base (264)..(264): a, c, t, g, unknown or other
  modified_base (283)..(283): a, c, t, g, unknown or other
  modified_base (521)..(521): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagcccaccctgtctgtgtctccgaaggggaaancgccacctctcctgcagggccagtcagagtatagcagcaacttagcctaggaccagcaagaaaccnggccagctccagcctcctnatctatgctgcactcccgaccgagggcccaacgtcggtaactccccgagtcccgtaacggttcaggtggctagggtcggggtacgtggggaactagggtagttccattcctacaccatcagcacgccttgacgtagtcgtagtaagttattttgactttaaattttataactgtacaagactaagtaataagtaacgtggtacgtacgttcggaacgtaaagggaacaaagggtaaanaaacgtaaacgaaacgttacgttggacggtaactacgaacctactattcttcgttccttcg

SEQ ID NO: 442067 - DNA, 557 bp, Homo sapiens
  misc_feature: GZ8MTXP01B3SNW.2.7.A07.1.454.CMB.2.raw
  modified_base (197)..(197): a, c, t, g, unknown or other
  modified_base (381)..(381): a, c, t, g, unknown or other
  modified_base (500)..(500): a, c, t, g, unknown or other
  modified_base (544)..(544): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagcaacgaaacctggaccaggcctcccaggcctcctcatctatcgctgcatccaccagggcctacgtgtactcccagccaggttcagtggcaggtgggtctggggacagtcgttcagttctacacctntcacgcagccctgactagtctagaagttatttgacttaattttattactgtacaggtctaagttaataagttaacgtgggttacgacgttacgggacgtaaaggggaccaaagggtaanaaacgtacgaaagttacgttggttacggtcacggcctaaccgtnttctcgttctaac

SEQ ID NO: 442068 - DNA, 688 bp, Homo sapiens
  misc_feature: GZ8MTXP01DYGHU.2.7.A07.1.454.CMB.2.raw
  modified_base (194)..(194): a, c, t, g, unknown or other
  modified_base (476)..(476): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagattccactggagaagtggtgatgacgcagtctccagccaccctgtctgtgtctcgagggaancgccacctctcctgcagggccagtcagtagtatagcagactaacttagcctaggtaccagcaagaaacctggccaggcctcccgaggccctcctacacttctatcgtctcgactacctaccccgaccggaccggaccctacggttacggtaccctacccgacgtaccggtacggtaccgtaggtcggacgtagggtcgggttacggagggaacgtaggttacgttactacttccacctactatacgacgacacgtctgacgttagtacgtaagtaacgtttnttacgtaactttaattttacttacggttacgtactaggtactaaagttaaactaaacgttacggttacggggtacgttaaccgggtaccggaaaccggtaaacgggaaacgttaaagggaaacgtaaaccgttaaacgtaaaccggtagttcgggacgttacgtaaccaaacctaacgttaactccgtttacgttccttaacgttaaccccg

SEQ ID NO: 442069 - DNA, 772 bp, Homo sapiens
  misc_feature: GZ8MTXP01ECKNE.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaaggggaancgccaccctctcctgcgagggccagtcagagtatagcagactaacttagcctaggtaccagacaagaaaccgcggaccacggcctcccgaggtcctcctcatctatcgctcgactactccccgaaccggacgggtaccctacgttacggtaccctaccccgacggtcccgttaacgggttccgaagggttcgggaccggtaggggttcgggggtacgttaacgggggaacctaagggtacgtttacctaacgtttccgtacccgtaaaccctagttaccgaacggcccgtaacggtcccttagggtacccttaaggttaccgttaaggtaaacggtttattttttacggaaaccttttaaaagttttttacgttaacgttaggttaaccaacgttaacgttaaagttaacttaaaacgtttaaccggttgggggttacgggttaaacccggtttaccgggaaacccggtaaaaggggaacccgttaaaaggggttaaacttaaaacgtaaccgtaaaaacggttacgttcggttacgtaacttacgaacctacgtattccgttcgttccttaaccg

SEQ ID NO: 442070 - DNA, 559 bp, Homo sapiens
  misc_feature: GZ8MTXP01CY82H.2.7.A07.1.454.CMB.2.raw
  modified_base (196)..(196): a, c, t, g, unknown or other
  modified_base (207)..(207): a, c, t, g, unknown or other
  modified_base (263)..(263): a, c, t, g, unknown or other
  modified_base (288)..(288): a, c, t, g, unknown or other
  modified_base (466)..(466): a, c, t, g, unknown or other
  modified_base (520)..(520): a, c, t, g, unknown or other
  modified_base (540)..(540): a, c, t, g, unknown or other
  modified_base (548)..(548): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccatggagaagtggtgatgacgcagtctccagccaccctgtctgtgtctccgaggggaancgccaccctcnctgcagggccagtcagagtatagcagcaacttagcctaggtaccagcaagaaaccnggccaggcctacccgaggcctcctnatctatcgctgccaactcccaccgtacgggcccaacgttggtacctccccagcccgtacgggtttccgagggttcggacgtaggtcggggttactgggggaactaggtacgtttcattctacactatcgaagcagcctagctagttctagtaatatttgaacttaatttatactgtanagtctaagtaataagtacgtggtagtacgtcggacgaaagggacaagggtaaanaagtacgaagttgttgacgntgctactnttctcgttctc

SEQ ID NO: 442071 - DNA, 556 bp, Homo sapiens
  misc_feature: GZ8MTXP01C51KI.2.7.A07.1.454.CMB.2.raw
  modified_base (199)..(199): a, c, t, g, unknown or other
  modified_base (265)..(265): a, c, t, g, unknown or other
  modified_base (409)..(409): a, c, t, g, unknown or other
  modified_base (495)..(495): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtcctccgaaggggaanacgccaccctctcctgcagggccagtcagagtatagcagcaacttgcctggtaccagcaagaaccnggccaggctcccgaggctcctcatctatgctgcatcccaccgagggcccacgtggtactcccgagcctacggttccaggtggcaggtgggtctggggacaggtagttcattctacaccatcagcagcctgcagtctagaagttntttgacttaatttacttactgtcagtactagttaataacgtaacgtggggtcgtacggttcggaccgaaaggggacaaagggtaanaaacgttacgaaacgttaacgttggttacgctagctaccgtattccgttcgttctttaacc

SEQ ID NO: 442072 - DNA, 551 bp, Homo sapiens
  misc_feature: GZ8MTXP01AECOZ.2.7.A07.1.454.CMB.2.raw
  modified_base (196)..(196): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcagaaaccnggccaggctcccaggcctcctcatctatgctgcatcccaccagggcccacgtggtactcccgagccgtaggttccaggtcggctagggtcgggtcgtggggactaggtagttcattctacacatcagcacgcctgctagtctagaagtatttgacttaatttatacttgtcagtctagtaacttaaagtaacgtggtacggtaacgttcggacgtaagggaccaaagggtaacaaacgtacgaaacgacgttggttggctagcctacgtattccgtaagttcctttaacg

SEQ ID NO: 442073 - DNA, 536 bp, Homo sapiens
  misc_feature: GZ8MTXP01EG114.2.7.A07.1.454.CMB.2.raw
  modified_base (197)..(197): a, c, t, g, unknown or other
  modified_base (261)..(261): a, c, t, g, unknown or other
  modified_base (278)..(278): a, c, t, g, unknown or other
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaacngcagctccaggctcctnatctatgctgcatccacgagggccacgtggtactcccgagcctaggttcagtcggcaggtcgggtctggggacaggtagttcagttcncaccatcagcagcctgacagtctagaagtatttgacttaatttattactgttacagtctaagttattaaagtaacgtgggtacggtacggttcgggaccgaaaggggtaccaaagggtaacgaaatacgaaaacgacgttggttacggctgaacactattctgttccttc

SEQ ID NO: 442074 - DNA, 531 bp, Homo sapiens
  misc_feature: GZ8MTXP01BZ5UU.2.7.A07.1.454.CMB.2.raw
  modified_base (196)..(196): a, c, t, g, unknown or other
  modified_base (262)..(262): a, c, t, g, unknown or other
  modified_base (283)..(283): a, c, t, g, unknown or other
  modified_base (368)..(368): a, c, t, g, unknown or other
  modified_base (519)..(519): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaaccnggccaggctcccaggctcctnatctatgctgcatcccaccagggcccacgtggtactccccagccaggttcaggtggcaggtgggtctggggacagagttcattcncaccatcagcagcctgcagtctgaagtatttgacttaatttattactgtcagtcaagtataataacgtggtaggtacgttcgggccaaaggggtaccaaaggggttaaacgaaacgtaacgaaacgttacgttggttacgctgaaccactnttctcgttcttc

SEQ ID NO: 442075 - DNA, 567 bp, Homo sapiens
  misc_feature: GZ8MTXP01EKAKB.2.7.A07.1.454.CMB.2.raw
  modified_base (198)..(198): a, c, t, g, unknown or other
  modified_base (263)..(263): a, c, t, g, unknown or other
  modified_base (389)..(389): a, c, t, g, unknown or other
  modified_base (420)..(420): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaangccaccctctcctgcagggccagtcagagtatagcagcaacttagcctggtaccagcaagaaccnggccaggcctcccgaggcctcctcatctatcgctgcactcccaccgacgggcccacgtggtactcccgagcctagggttccaggtggctagggtcggggtctgggggactagggtacgttcattcncaccatcagcagcctgacagtctagaagttntttgacttaatttattactgtacagtactaagtaattaagtaacgtgggtacggtacgttcggacctaaaggtacggaaacgtaaaggttaaactaaacgtaacgaaaacgttgttggtcgcgtcgacctacttattcgttcgttcc

SEQ ID NO: 442076 - DNA, 541 bp, Homo sapiens
  misc_feature: GZ8MTXP01AHICG.2.7.A07.1.454.CMB.2.raw
  modified_base (198)..(198): a, c, t, g, unknown or other
  modified_base (286)..(286): a, c, t, g, unknown or other
  modified_base (415)..(415): a, c, t, g, unknown or other
tcagacgctcgacacacgaccggtgctcgatttagcacgtgtcgcagggagaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangccaccctctcctgcagggccagtcagagtatagcagcaacttagcctggtaccagcagaaacctggccaggctcccgaggcctcctnatctatgctgcactcccacgacgggcccagtcggtactccccgagcccccagggttcaggtggcaagggttggggtctggggacagtagttcattcacaccatcagctagcctgctagtctagaagttntttgacttaaattttatacttgtacagtctaagttaataaagtaacgttggtacggtcgttcggaacgaagggacctaaaggttagaaactacgaaacgcgttgtggctgcaccattccttgttcc

SEQ ID NO: 442077 - DNA, 587 bp, Homo sapiens
  misc_feature: GZ8MTXP01C65YK.2.7.A07.1.454.CMB.2.raw
  modified_base (196)..(196): a, c, t, g, unknown or other
  modified_base (264)..(264): a, c, t, g, unknown or other
  modified_base (289)..(289): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttagcctggtaccagcaagaaaccnggaccaggcctcccgaggcctcctnatctatcgctgccactccccaccgacgggcccacgttcggtactccccaggcccctagggttccaggtggcgtagggtcggggtctggggactaggtacgttcacttctcacctatcagcacgtcctgactagtctaggtaacgttatttgacttaatttattactgtacagtactaagtaataagttaacgtgggtaggtaccgttcgggaccgtaaaggggtaaccaaagggtaacgaaacgttaacgaaacgttacgttggttacggctagccaaccgtattcttcgttccttcg

SEQ ID NO: 442078 - DNA, 520 bp, Homo sapiens
  misc_feature: GZ8MTXP01AM9JE.2.7.A07.1.454.CMB.2.raw
  modified_base (197)..(197): a, c, t, g, unknown or other
  modified_base (261)..(261): a, c, t, g, unknown or other
  modified_base (362)..(362): a, c, t, g, unknown or other
  modified_base (468)..(468): a, c, t, g, unknown or other
  modified_base (509)..(509): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaccnggccaggctcccaggctcctcatctatgctgcatccaccgagggcccagtgtactcccagccaggttcaggtgcagtgggtctgggacagtagttcattcncaccatcagcagcctgctagtctagaagttatttgacttaatttattactgtcagactagtactaataacgtgggtcgacgttcggacaagggacttaaagggtanaaatacgaaacgttacgttgttggaacctgaaccaaccgtnttctcgttctc

SEQ ID NO: 442079 - DNA, 581 bp, Homo sapiens
  misc_feature: GZ8MTXP01EDCY1.2.7.A07.1.454.CMB.2.raw
  modified_base (266)..(266): a, c, t, g, unknown or other
  modified_base (373)..(373): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggtaccagcaagaaaccnggccaggcctcccaggctcctcatctatgctgccatccaccagggccacgtggtactcccagcctaggttcagtggcaggtgggtctggggacagtagttcatttcncaccatacagcagcctgacctagtctagaagtatttgacttaatttacgttaattgtacaagtctaagttaataaataacgtgggtacggtacggttacggaccgtaaaggggtaaccaaaggggtaaacaaacgttaaacgaaaacggttaaacgttggttacggaacttaggaacctaacccgtattccgttcgttcgtttaaccg

SEQ ID NO: 442080 - DNA, 524 bp, Homo sapiens
  misc_feature: GZ8MTXP01DL0NZ.2.7.A07.1.454.CMB.2.raw
  modified_base (196)..(196): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttgcctggtaccagcaagaaaccnggccaggctcccaggcctcctcatctatgctgcatcccaccgagggcccacgtggtactcccagcctaggttcaggtggctaggtcgggtctggggactaggtacgttcattctcaccatcagcagcctgctagtctagaagtatttgacttaatttattactgtacagctagtataataacgtggtgacgttcggactaaagggacaaaggtaagaaatacgaaacgttaacgttggttaggctgctacattctgttcttc

SEQ ID NO: 442081 - DNA, 538 bp, Homo sapiens
  misc_feature: GZ8MTXP01CJV0F.2.7.A07.1.454.CMB.2.raw
  modified_base (197)..(197): a, c, t, g, unknown or other
  modified_base (264)..(264): a, c, t, g, unknown or other
  modified_base (286)..(286): a, c, t, g, unknown or other
  modified_base (377)..(377): a, c, t, g, unknown or other
  modified_base (408)..(408): a, c, t, g, unknown or other
  modified_base (484)..(484): a, c, t, g, unknown or other
  modified_base (523)..(523): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcaagaaaccnggccaggctcccaggcctcctnatctatgctgcatcccaccgagggccacgtggtactcccgagcctaggttccaggtggctaggtcgggtctggggacaggtagttcattcncacctatcagcagcctgctagtctagaagtntttgacttaatttattactgtacagtctaagtataatacgtggtagtacgttcggacgaaagggacaaagggtaanaaagtaacgaaacgttacgttggttacggctagccactnttctcgttcttaacg

SEQ ID NO: 442082 - DNA, 627 bp, Homo sapiens
  misc_feature: GZ8MTXP01BVWZH.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttgcctggtaccagcaagaaacctggaccaggcctcccgaggcctccctcatctatgctgcactcccacgacgggccacgtggtactcccgagccctaaggttccaggtggctaggtcgggtctgggggaacagggtacgtttcaatttcgaccacctatcgaagccagtccctaggacctaaggttctagggtaaattagtttttacggactttaaatttttattaacgttggttaccagtactaagttaacttaaagtaacgtgggtacggtacgttcgggaaccgtaaaggggaccttaaagggtaaacaaacgttacgaaaacggttaacgttggttacgggaacttacgaaccaaccctagttcgttcggttcctttaacc

SEQ ID NO: 442083 - DNA, 532 bp, Homo sapiens
  misc_feature: GZ8MTXP01BE156.2.7.A07.1.454.CMB.2.raw
  modified_base (196)..(196): a, c, t, g, unknown or other
  modified_base (262)..(262): a, c, t, g, unknown or other
  modified_base (364)..(364): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaaccnggccaggctcccaggctcctcatcctatgctgcatcccacagggcccatggtactcccagccaggttcagtggcaggtgggtctggggacagagttcattcncaccatcagcagcctgctagtctgaagtattttgacttaaatttagttacttgtcagctaagtataataacgtggtggtacgttcggcctaaagggtacaaaggttaacgaaattaccgaaacgttaacgttgttacggctaggaaccaccgtattcctgttcttaac

SEQ ID NO: 442084 - DNA, 561 bp, Homo sapiens
  misc_feature: GZ8MTXP01ASBWP.2.7.A07.1.454.CMB.2.raw
  modified_base (196)..(196): a, c, t, g, unknown or other
  modified_base (263)..(263): a, c, t, g, unknown or other
  modified_base (374)..(374): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggctcctcatctatgctgcatcccaccagggcccactggtactcccagccaggttcaggtggcaggtgggtctggggacaggtagttcattcacaccntcagcagcctgcagtctagaagttattttgacttaatttagttactgtacagtctaagtattaaagtacgttgggtaggtaccgtttcgggacctaaaggggaacccttaaaggggtaacaaaacgtacgaaaacggttacgttggttagggaactggaaccaacctattccgtgttcctttaaccg

SEQ ID NO: 442085 - DNA, 541 bp, Homo sapiens
  misc_feature: GZ8MTXP01BG6DJ.2.7.A07.1.454.CMB.2.raw
  modified_base (198)..(198): a, c, t, g, unknown or other
  modified_base (262)..(262): a, c, t, g, unknown or other
  modified_base (315)..(315): a, c, t, g, unknown or other
  modified_base (367)..(367): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgccaccctctcctgcagggccagtcagagtatagcagcaacttgcctggtaccagcagaaccnggcaggctccagctcctcatctatgctgcactccacgacgggccagtggtacncccagccaggttcaggtgcgtaggtgggtctggggacaggtagttcagttcncaacctatcacgcacgcctgactagtctagaagttatttgacttaatttagtaacttgtaccagtacagttataataacgtggtacgtacgttcggacgtaaagggacgaaagggtaacaaagtacgaaacgttaacgttggttacggcttcgcacattcctgttaaccttccg

SEQ ID NO: 442086 - DNA, 526 bp, Homo sapiens
  misc_feature: GZ8MTXP01CQ3HJ.2.7.A07.1.454.CMB.2.raw
  modified_base (196)..(196): a, c, t, g, unknown or other
  modified_base (264)..(264): a, c, t, g, unknown or other
  modified_base (286)..(286): a, c, t, g, unknown or other
  modified_base (410)..(410): a, c, t, g, unknown or other
  modified_base (506)..(506): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcaagaaaccnggccaggctcccaggcctcctnatctatgctgcatcccaccagggccacgtggtactcccgagcctaggttcagtggctaggtcgggtcgtggggacaggtacgtttcagtttcacacctatcagcagcctgctagtctagacgtntttgacttaatttattacgtgtacagtctaagtataagtacgtggtacggtacgttacgacgtaaagggacaaggtacaaagtacgaagagttggngctgcacattctgttctaac

SEQ ID NO: 442087 - DNA, 562 bp, Homo sapiens
  misc_feature: GZ8MTXP01BNLY6.2.7.A07.1.454.CMB.2.raw
  modified_base (195)..(195): a, c, t, g, unknown or other
  modified_base (261)..(261): a, c, t, g, unknown or other
  modified_base (358)..(358): a, c, t, g, unknown or other
  modified_base (403)..(403): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaanagccaccctctcctgcagggccagtcagagtatagcagcaacttagcctggtaccagcagaaaccnggccaggctcccaggctcctcatctatgctgcatccacagggccacgtgtactccagccaggttcagtgcagtgggtctgggacagagttcatttcncaccatcagcagcctgccagtctgaatcgttttgacttaattttnttacttgtcagtcaagttataagttaaacgtgggtaggtacgttcgggccgtaaaggggtaaccaaagggttaaacggaaattaaccgaaaaacggttaacgttcggttaggggaaccttacggaaccaaccctagttaccttcgttcccgtttaaccg

SEQ ID NO: 442088 - DNA, 540 bp, Homo sapiens
  misc_feature: GZ8MTXP01D27NV.2.7.A07.1.454.CMB.2.raw
  modified_base (197)..(197): a, c, t, g, unknown or other
  modified_base (266)..(266): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcaagaaaccnggccaggctcccgagctcctcatctatgctgcatccacgagggccagtgactcccagccaggttcaggtgctaggtcgggtctggggacaggtagtttcattcacacctatcagcagcctgactagtctagaagtntttgacttaatttatactgtacagtactaagtataataacgtggtagtacgttcggacgtaaagggccttaaagggtacgaaagtaccgaaaacgttacgttggttacggcttacggctaccgattcttgttctttcg

SEQ ID NO: 442089 - DNA, 565 bp, Homo sapiens
  misc_feature: GZ8MTXP01EE099.2.7.A07.1.454.CMB.2.raw
  modified_base (197)..(197): a, c, t, g, unknown or other
  modified_base (206)..(206): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctntcctgcagggccagtcagagtatagcagcaacttgcctggtaccagcaagaaacctggccaggcctcccgggctcctcatctatgctgcatccaccgaggcccatggtactcccagccaggttccaggtggcaggtgggtctggggaacagtagttcattcctcactatcagcagcctgcagtctagtaatatttgacttaatttatacgtgtacagtactaagttaactaaagttacgtgggtaggtaccggttacggaccgtaaagggggaacctaaaggggttaacgaaaacgttacgaaaacggtaacgttgggttcgacttggacctaaccgtattcttagttccttcgtaacc

SEQ ID NO: 442090 - DNA, 616 bp, Homo sapiens
  misc_feature: GZ8MTXP01D8GK1.2.7.A07.1.454.CMB.2.raw
  modified_base (197)..(197): a, c, t, g, unknown or other
  modified_base (385)..(385): a, c, t, g, unknown or other
  modified_base (416)..(416): a, c, t, g, unknown or other
  modified_base (449)..(449): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggcctcccaggcctcctcatctatgctgcatcccacgacgggccacgtggtactcccagccctaggttccagtggcgaggtcggggtctgggggactaggtacgttcagtttccncaccatcagcagcctgctagtctagaagttntttagacttaaattttacttaactggtacagtntaagttaattaaacgttaacgttggggtacgggtaacccggtttcgggaaccgtaaaacgggggtaaccaaaaggggttaaacggaaaacttaaaccgaaaaaccggttaagttcgggttagggtccttaggaaccctaaccgatttcgtaacgtttcctttaaccg

SEQ ID NO: 442091 - DNA, 538 bp, Homo sapiens
  misc_feature: GZ8MTXP01CWY6K.2.7.A07.1.454.CMB.2.raw
  modified_base (197)..(197): a, c, t, g, unknown or other
  modified_base (263)..(263): a, c, t, g, unknown or other
  modified_base (284)..(284): a, c, t, g, unknown or other
  modified_base (374)..(374): a, c, t, g, unknown or other
  modified_base (489)..(489): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcaagaaaccnggccaggctcccaggctcctnatctatgctgcactcccaccaggggcccactggtactcccagcctaggttcagtggctaggtcgggtctggggactagtagttcagttcncacatcagcagcctgacagtctagaagtatttgacttaatttagttactgtacagtactaagtaattaagtaacgtggtacggtacgttcgggactaaacggggacaaagggtanaaagtaacgaaacgaacgttgttacgggctaggcactattctgttcttc

SEQ ID NO: 442092 - DNA, 636 bp, Homo sapiens
  misc_feature: GZ8MTXP01C0R7V.2.7.A07.1.454.CMB.2.raw
  modified_base (195)..(195): a, c, t, g, unknown or other
  modified_base (261)..(261): a, c, t, g, unknown or other
  modified_base (283)..(283): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaancgccaccctctcctgcgagggccagtcagagtatagcagcaacttgcctggtaccagcaagaaccnggccaggcctcccaggctcctnatctatcgctgccactcccgaccgacgggcctacgttggtaacctcccgagtccccgtaagggttccgaggtggccgtagggttcggggtactgggggactagggtacgtttcagtttccacaaccctatccgaagccgtacgccctgtacctaggttactaggtaaagttagttttacgaactttaaatttttagttacgttggttactagtactaagttaattaacgttaacgttgggtacgtacggttacgggaaccgaaagggtaaccgaaagggttaaagaaactaaccgtaaacggttacgttgggttaacgtctaagcctaacgtacttcgttcgttctttaaccc

SEQ ID NO: 442093 - DNA, 531 bp, Homo sapiens
  misc_feature: GZ8MTXP01CV04M.2.7.A07.1.454.CMB.2.raw
  modified_base (196)..(196): a, c, t, g, unknown or other
  modified_base (263)..(263): a, c, t, g, unknown or other
  modified_base (368)..(368): a, c, t, g, unknown or other
  modified_base (398)..(398): a, c, t, g, unknown or other
  modified_base (505)..(505): a, c, t, g, unknown or other
  modified_base (515)..(515): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggcctcccaggcctcctcatctatgctgcatcccaccgagggccacgtggtactcccagccaggttcagtggcaggtgggtctgggacagtgttcattcncacatcagcagcctgacagtctagaagttntttgacttaaatttagttactgttcaagtcaagttataagtacgtggtcggtacgttcggacgaagggtaacaaggtacgaaagtacgaaacgttacgttgttacgntcgctacgtnttactgttctttaacc

SEQ ID NO: 442094 - DNA, 508 bp, Homo sapiens
  misc_feature: GZ8MTXP01DOSZN.2.7.A07.1.454.CMB.2.raw
  modified_base (197)..(197): a, c, t, g, unknown or other
  modified_base (264)..(264): a, c, t, g, unknown or other
  modified_base (286)..(286): a, c, t, g, unknown or other
  modified_base (472)..(472): a, c, t, g, unknown or other
  modified_base (489)..(489): a, c, t, g, unknown or other
  modified_base (497)..(497): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcaagaaacnggccaggctcccaggcctcctnatctatgctgcatccaccgagggccagtggtactcccagccaggttcagtgcaggtcgggtctggggacaggtacgttcattctcacctatcagcagcctgacagttctgaagttatttgacttaattttatactgtcagtctaagtataagtaacgtggtgtacgtcgcgaaagggacaggtaanaatacaagttacgttgngctgcacnttctgttcttc

SEQ ID NO: 442095 - DNA, 519 bp, Homo sapiens
  misc_feature: GZ8MTXP01DM4F4.2.7.A07.1.454.CMB.2.raw
  modified_base (264)..(264): a, c, t, g, unknown or other
  modified_base (285)..(285): a, c, t, g, unknown or other
  modified_base (378)..(378): a, c, t, g, unknown or other
  modified_base (406)..(406): a, c, t, g, unknown or other
  modified_base (477)..(477): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaaccnggccaggctcccaggctcctnatctatgctgcactccaccgagggcccacgtcggtactcccgagcctaggttccagtcggcaggtcgggtctggggactaggtagttcattcncaccatcagcagcctgcagtctgaagtntttgacttaatttagttactgtcagtctaagtaataataacgtggtgtacgtcgacgaagggaacaggtanaaagtcgaaacgttagttgttggctgcacgattcgtgttctc

SEQ ID NO: 442096 - DNA, 533 bp, Homo sapiens
  misc_feature: GZ8MTXP01DUE6E.2.7.A07.1.454.CMB.2.raw
  modified_base (197)..(197): a, c, t, g, unknown or other
  modified_base (263)..(263): a, c, t, g, unknown or other
  modified_base (282)..(282): a, c, t, g, unknown or other
  modified_base (429)..(429): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccacctctcctgcagggccagtcagagtattagcagcaacttagcctggtaccagcagaaaccnggcaggctccaggctcctnatctatgctgcatcccacgagggcccacgtggtactcccgagccaggttcagtggcaggtcgggtctggggacaggtagttcattcacaccatcagcagcctgctagtctagaagttatttgacttaaatttattactgtacagtanaagttataataacgtggtaggacgttcggacgtaaggggaccaaagggtaacgaaatacgaaacgttacgttgttcggctaggcaccagttctaagttcttaac

SEQ ID NO: 442097 - DNA, 590 bp, Homo sapiens
  misc_feature: GZ8MTXP01ALZAP.2.7.A07.1.454.CMB.2.raw
  modified_base (196)..(196): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtattagcagcaacttagcctggtaccagcagaaccnggccaggcctcccaggcctcctcatctatgctgcactcccaccgagggcccacgtggtactcccgagcccgtaggttcaggtcggcaggtcgggtctggggactaggtagttcattctacaccatcagcagcctgactagtctagtaagttatttagacttaagttttactacttggtcaagtactaagttaattaaagtaacggttgggtacggtaaccggttacgggaccgaaaggggtaaccttaaagggtaacgaaacgtacgaaaacgttacgttggttacggtaacgtacgaactacccgtattccttcgttccttaacccg

SEQ ID NO: 442098 - DNA, 571 bp, Homo sapiens
  misc_feature: GZ8MTXP01EPYHB.2.7.A07.1.454.CMB.2.raw
  modified_base (196)..(196): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggcctcctcatctatgctgcatcccaccagggccacgtggtactcccagccaggttcaggtcggcaggttcgggtctgggggactagggtacgtttcagtttctcaccatcagcaggccctggaccaggttctaggaagtattttgacttaaattttagttacttgttcagtctaagttaataagttaacgttgggtgtacggtttaccggacccgtaaaggggaccaaagggtaacgaaagtacgaaaacgaacgttggttaggcttaggcctacctattccttcgttcttaac

SEQ ID NO: 442099 - DNA, 526 bp, Homo sapiens
  misc_feature: GZ8MTXP01EXHM2.2.7.A07.1.454.CMB.2.raw
  modified_base (197)..(197): a, c, t, g, unknown or other
  modified_base (261)..(261): a, c, t, g, unknown or other
  modified_base (281)..(281): a, c, t, g, unknown or other
  modified_base (363)..(363): a, c, t, g, unknown or other
  modified_base (372)..(372): a, c, t, g, unknown or other
  modified_base (400)..(400): a, c, t, g, unknown or other
  modified_base (481)..(481): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttgcctggtaccagcagaaccnggccaggctccaggctcctnatctatgctgcatcccaccgagggcccacgtggtactccccgagcctaggttccaggtggctaggtgggtctggggacaggngttcattcncaccatcagcagcctgctagtcagagtntttgacttaatttatactgtacagtctaagtataagtacgtggtaggtacgttcggaccgaaaggggtaccaaagggtaanaaactacgaaagacgttggcggtctgcactattctgttccttaac

SEQ ID NO: 442100 - DNA, 599 bp, Homo sapiens
  misc_feature: GZ8MTXP01ETPRR.2.7.A07.1.454.CMB.2.raw
  modified_base (198)..(198): a, c, t, g, unknown or other
  modified_base (265)..(265): a, c, t, g, unknown or other
  modified_base (438)..(438): a, c, t, g, unknown or other
  modified_base (568)..(568): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagcaacttagcctggtaccagcaagaaccnggccaggcctcccgaggcctcctcatctatgctgcactcccaccgacgggccctacgtggtactcccgagtcccgtaggttcaggtggcgtagggttcgggtcgtggggactaggtacgttctagttcctacaccctatcgagcacgtccctgtaccagttcgtagtaaattntttagaacttaattttacttacgttgtacgagtacttaagttaacttaaagttaacgtgggtacggtaccgttacgggaaccgtaaagggaacgaaagggtaacaaagtacgaaacgttagttggacgtntcgaacctactagttctaacgttcttaaccg

SEQ ID NO: 442101 - DNA, 608 bp, Homo sapiens
  misc_feature: GZ8MTXP01EVW6S.2.7.A07.1.454.CMB.2.raw
  modified_base (197)..(197): a, c, t, g, unknown or other
  modified_base (422)..(422): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcaagaaacctggccaggcctcccaggcctcctcatctatgctgcactcccaccgacgggcccacgtggtaactccccgagccctaggttccaggtcggcaggttggggtctgggggacaggtagtttcagtttcacacctatcagcagcctgacagtctagaagtntttgacttaatttacttacttgtacagtactaagtaataaagtaacgtggtacgggtacgttacggaaccgtaaaggggtaaccgttaaagggtaaacggttaaactaaccggaaaaacggacgttgggttacgggtaaccttacggaacctaacccgtaattccgttcggtttaacctttaaccg

SEQ ID NO: 442102 - DNA, 552 bp, Homo sapiens
  misc_feature: GZ8MTXP01B5U1T.2.7.A07.1.454.CMB.2.raw
  modified_base (197)..(197): a, c, t, g, unknown or other
  modified_base (354)..(354): a, c, t, g, unknown or other
  modified_base (364)..(364): a, c, t, g, unknown or other
  modified_base (484)..(484): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgcagggccagtcagagtattagcagcaacttagcctggtaccagcaagaaacctggccaggctcccgaggcctcctcatctatgctgcatccacagggccatggactccagccaggttcagtgcaggtgggtctgggacagngttcatttcncaccatcagcagcctgctagtctagaagtattttgacttaattttattacttgtcaagtctaagttataaagtaacgtggtagtacgttcgggaccaaaggggacccaaaggggttaaanaaacgtaacgtaaaacggttacgttggttacgtaactacgtaaccaacgtcttacgttcgttccttcg

SEQ ID NO: 442103 - DNA, 542 bp, Homo sapiens
  misc_feature: GZ8MTXP01CVM5W.2.7.A07.1.454.CMB.2.raw
  modified_base (197)..(197): a, c, t, g, unknown or other
  modified_base (208)..(208): a, c, t, g, unknown or other
  modified_base (264)..(264): a, c, t, g, unknown or other
  modified_base (285)..(285): a, c, t, g, unknown or other
  modified_base (318)..(318): a, c, t, g, unknown or other
  modified_base (344)..(344): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctcnctgcagggccagtcagagtattagcagcaaacttagcctggtaccagcagaaaccnggccaggctcccaggctcctnatctatgctgcatccaccagggcccatggtacnccagcctagtcagtgcaggtgggtcngggacagtagttcattcacacatcagcagcctagactagtctagaagttatttgacttaaatttagttacttgtacagtactaagtaataataacgtggtacggtacgtcggacgaaagggaacgaaaggtaacgaaagtaacgaaaacgttacgttgttacggtaactacgaaccaacctattcgtaacgttcgttc

SEQ ID NO: 442104 - DNA, 545 bp, Homo sapiens
  misc_feature: GZ8MTXP01EX56O.2.7.A07.1.454.CMB.2.raw
  modified_base (197)..(197): a, c, t, g, unknown or other
  modified_base (264)..(264): a, c, t, g, unknown or other
  modified_base (373)..(373): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcattctccagccaccctgtctgtgtctccgaggggaaanagccaccctctcctgcagggccagtcagagtatagcagcaacttagcctggtaccagcaagaaaccnggccaggctcccaggcctcctcatctatgctgcatcccaccgagggccacgtggtactcccgagccaggttcaggtggcaggtgggtctggggacaggagttcatttcncaccatcagcagcctgcagtctagaagtntttgactaatttattactgtcagtctaagtaataagttaacgtgggtacggtacggttcggaccgtaaaggggaaccttaaagggtaacgaaacgtacgaaaacgttacgttggttacgctgccacgtattcttgttcttaac

SEQ ID NO: 442105 - DNA, 546 bp, Homo sapiens
  misc_feature: GZ8MTXP01EQE5O.2.7.A07.1.454.CMB.2.raw
  modified_base (263)..(263): a, c, t, g, unknown or other
  modified_base (367)..(367): a, c, t, g, unknown or other
  modified_base (397)..(397): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttagcctggtaccagcagaaaccnggccaggctcccaggctcctcatctatgctgcatcccacacgggccactgtactcccagccaggttcagtggcaggtgggtctggggacaggtagttcatttcnacccatcagcagcctgacagtcagaaagtntttgacttaaatttattacgttagtcaaggctaagtaataaagttacgtgggtacggtaccggttacgggccgaaaaggggaccaaagggtaacaaagtacaaaacggttaacgttggttacggctagcctaactattactgttccttc

SEQ ID NO: 442106 - DNA, 533 bp, Homo sapiens
  misc_feature: GZ8MTXP01DMI47.2.7.A07.1.454.CMB.2.raw
  modified_base (196)..(196): a, c, t, g, unknown or other
  modified_base (407)..(407): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttagcctggtaccagcaagaaacctggccaggctcccaggcctcctcatctatgctgcatcccacgacgggcccacgtggtactcccagccctaggttcaggtggcaggtcgggtctgggggacaggtacgttcattctcaccatcagcagcctgacagtctagagttntttgactaatttatactgtacagtactaagttataataacgtggtagtacgttcggacgaagggacaaggtaagaaagtacgaaacgttaacgttggttaggctacgcaacattcttcgttcttcc

SEQ ID NO: 442107 - DNA, 614 bp, Homo sapiens
  misc_feature: GZ8MTXP01EPW1M.2.7.A07.1.454.CMB.2.raw
  modified_base (268)..(268): a, c, t, g, unknown or other
  modified_base (314)..(314): a, c, t, g, unknown or other
  modified_base (329)..(329): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgcccaccctctcctgcgagggccagtcagagtatagcagcaacttagcctggtaccagcaagaaaccnggaccaggcctacccgaggcctcctcatctatgctgcactccacgngggccacgtggtacnccagcctaggtcagtgctaggtgggctggggactaggtacgttctacttcctcaacccatccgagcacggccttggacctagggttctaggtaaagttacttttacgaactttaaatttttaacgttacgttaggtacctaaggtactaagttaaataaagttaacggtggggttacgtaccgttacgggaccgtaaaaggggtaaccttaaaggggtaaacttaaataaccggaaaacgttacgttggacggtctcgaacctactagttctaacgttcttaacc

SEQ ID NO: 442108 - DNA, 655 bp, Homo sapiens
  misc_feature: GZ8MTXP01BHSA1.2.7.A07.1.454.CMB.2.raw
  modified_base (197)..(197): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaaccnggccaggctcccaggctcctcatctatgctgcatccaccgagggccacgtggtactcccagcctaggttcagtggcaggtgggtctggggactaggtacgtttcatttcctacaaccctatcgaaggcacggtcccttggacctaggttcctaggtaaagttatttttaggaacctttaaagtttttacgtttaacgtttaggttacctaaggtacctaaaggttaaatttaaacgttaaacgttgggggttacgggtaaccggtttccggggaacccgtaaaagggggtaacccaaaaggggttaaacggaaaacttaaccggaaaaaccggttacgttagggttacgggtctacggaacctaacccgattccttcggttcctttaaccg

SEQ ID NO: 442109 - DNA, 565 bp, Homo sapiens
  misc_feature: GZ8MTXP01DRLQ0.2.7.A07.1.454.CMB.2.raw
  modified_base (197)..(197): a, c, t, g, unknown or other
  modified_base (546)..(546): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtatagcagcaacttagcctggtaccagcaagaaacctggaccaggcctcccaggcctcctcatctatgctgcatcccacgagggccagtgtactcccagcctaggttcaggtgcgtaggtgggtctgggggacagggtattcattctacacatcagcagcctgctagtctagtaagtattttacgattaaattttagtttaacctggttaccagtactaagttaataaagttaacgtgggtaggtaaccggttcgggaccgtaaaggggaaccttaaaggggtaacaaaattacgaaaacgttaagttggttagcgtancctacattctgttcttaac

SEQ ID NO: 442110 - DNA, 553 bp, Homo sapiens
  misc_feature: GZ8MTXP01DK7IY.2.7.A07.1.454.CMB.2.raw
  modified_base (197)..(197): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagngccaccctctcctgcagggccagtcagagtatagcagcaacttgcctggtaccagcaagaaccnggccaggctacccgaggcctcctcatctatcgctgcactccaccgagggcccacgtggtactcccagcctaggttcaggtggcaggtggggtctggggacagggtacgttcattctacacctatcagcacgtcctgactagtctagtaagttatttgacttaatttattactgttacagtactaagtataagtaacgtggtaggtaccggtacggaccgaaagggaacaaaggggtacaaagtacgaaagttacgttggttacggctgccacgtattcttcgttctttaacc

SEQ ID NO: 442111 - DNA, 602 bp, Homo sapiens
  misc_feature: GZ8MTXP01EUREU.2.7.A07.1.454.CMB.2.raw
  modified_base (197)..(197): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcacgggccagtcagagtattagcagcaacttgcctggtaccagcaagaaccnggccaggctcccgaggctcctcatctatgctgcatccacgagggccacgtgtactcccgagcctaggttccaggtggctaggtcgggtctggggactaggtacgtttcatttccacgaccctatcaacggcacggtccctgaccgtagttcgtaggtaagttattttcgaactttaaattttacgttaacgttgttaaccagtactaagttaataagtaacgtgggtaggtaccgttacgggaccgtaaaggggaaccttaaaggggtacaaacgtacgtaaaacgacgttggttacggctcggaacctaacctagttccttcgtttctttaaccg

SEQ ID NO: 442112 - DNA, 605 bp, Homo sapiens
  misc_feature: GZ8MTXP01AP1X4.2.7.A07.1.454.CMB.2.raw
  modified_base (197)..(197): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaaccnggccaggcctccgaggctcctcatctatgctgcatcccaccgagggcccacgtggtactcccgagcccaggttccaggtggcgtaggttcggggtctggggactaggtacgttcattcacaccatcagcagcctgacagttctagtaagttattttagactttaaagttttacttaacgtgttacaaggtactaaggttaaattaaagttaacggttggggtacggtaaccggtttacgggaacccgtaaaggggtaaccaaaggggttaacaaaacgttaaccgaaaacgttacgttggttacggcttagaacctaaccgtattccgttgttaaccttcg

SEQ ID NO: 442113 - DNA, 595 bp, Homo sapiens
  misc_feature: GZ8MTXP01B32HV.2.7.A07.1.454.CMB.2.raw
  modified_base (197)..(197): a, c, t, g, unknown or other
  modified_base (294)..(294): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccacctctcctgcagggccagtcagagtatagcagcaacttagcctaggtaccagcaagaaacctggccaggcctcccgaggcctcctcatctangctgccactcccaccgagggccctaacgtcggtactcccgagtccctaaggttccaggtggcctagggttcggggtctgggggaactagggtacgttcagtttcacacctatcgacggcacgtcctgactagtctagtaagttatttgactttaagtttacttacttgtacagtctaaagttataaattacgtgggtaacggtacgttacggaaccgtaaagggaaccaaagggtaaacaaacgttaacgaaacgttagttcggttacgctagaacctaacctagttcctcgtttcttaac

SEQ ID NO: 442114 - DNA, 566 bp, Homo sapiens
  misc_feature: GZ8MTXP01A5MMM.2.7.A07.1.454.CMB.2.raw
  modified_base (195)..(195): a, c, t, g, unknown or other
  modified_base (256)..(256): a, c, t, g, unknown or other
  modified_base (271)..(271): a, c, t, g, unknown or other
  modified_base (307)..(307): a, c, t, g, unknown or other
  modified_base (520)..(520): a, c, t, g, unknown or other
  modified_base (555)..(555): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaggggaancgccaccctctcctgcagggccagtcagatatagcagcaattgctggtaccagcagaaccngcagctccagctctnatctatgctgcactcccacgagggccacgtggtacncccgagcctaggttccaggtcggactagggtcggggtctggggactagggtacgtttcagtttcctacaaccctataccgagcacgtcccttagactaggtctaggtaaattattttacgaactttaattttacttacgtggtacctaggtactaaagttaataagttaacgtggtacggtacgttcggacgtaaagggaacaaagggtaaanaaacgtaacgaaagttcgttgacgctcaactactnttctcgttctc

SEQ ID NO: 442115 - DNA, 547 bp, Homo sapiens
  misc_feature: GZ8MTXP01CYALG.2.7.A07.1.454.CMB.2.raw
  modified_base (197)..(197): a, c, t, g, unknown or other
  modified_base (264)..(264): a, c, t, g, unknown or other
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcaagaaaccnggccaggctcccaggctcctnatctatgctgcatcccaccagggccacgtggtactcccagccaggttcaggtggcaggtcgggtctgggacagtgttcattctcacatcagcagcctgacagtctagaagtatttgacttaatttattactgttacagtacagttaataagtaacgttgggtacgtacggttcggaccgaaagggaaccaaagggtaagaaacgttaacgaaacgttaaacgttggacggaactgcctacgattccgttgttccgtttaacg

SEQ ID NO: 442116 - DNA, 554 bp, Homo sapiens
  misc_feature: GZ8MTXP01AV0Q0.2.7.A07.1.454.CMB.2.raw
  modified_base (197)..(197): a, c, t, g, unknown or other
  modified_base (266)..(266): a, c, t, g, unknown or other
  modified_base (383)..(383): a, c, t, g, unknown or other
  modified_base (415)..(415): a, c, t, g, unknown or other
  modified_base (543)..(543): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagctaacttagcctggtaccagcaagaaaccnggccaggcctcccgaggcctcctcatctatgctgcactccaccacgggcccacgtggtactcccgagtcctacggttcaggtggcaggtgggtctggggacagggtagttcatttcncacctatcagcagcctgactagtcagtaagtntttgacttaatttagttactgtacagtacaagttataaagttacgtgggtacggtacgttccgggaacgaagggtaaccgaaggtaacaaacgtacgaaaacgttacgttggttacggctagccactnttctgttctcg

SEQ ID NO: 442117 - DNA, 638 bp, Homo sapiens
  misc_feature: GZ8MTXP01EBF9Z.2.7.A07.1.454.CMB.2.raw
  modified_base (197)..(197): a, c, t, g, unknown or other
  modified_base (325)..(325): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagacaacgaacctggaccacggcctcccgaggcctcctcactctatgctgcatccacgacggccacgtgtacnccgagcctacggtcagtggctaggtcgggtcgtggggactagtacgttctattccactacctatcagccacgccctggtacgtacgttcgtaagtaaagttattttacgaactttaaagtttttacgtttacgttggttaccaaggtataaagttaattaaagttaaacggttgggttacgggtaacggttccgggaaccggaaaacggggtaaacccgttaaagggtaaacgaaacgtaaaccgtaaaacggttacgttgggacgggtaactacgtaacctaacccgtattccgttcgtttccctttaaccg

SEQ ID NO: 442118 - DNA, 623 bp, Homo sapiens
  misc_feature: GZ8MTXP01AJR3O.2.7.A07.1.454.CMB.2.raw
  modified_base (265)..(265): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaagcgccaccctctcctgcagggccagtcagagtattagcagctaacttgccgtggtaccagcagaaaccnggccaggcctcccaggctcctcatctatgctgcactccaccgagggccacgtcggtactccacgccgtacgttcagtcggctaggtgggtcgtgggacaggtattcattcgacacctatcacgcgacgtcctagcctagttctaggtaaattcgttttagaactttaagtttacttacgtcgttacaggtaccttaaaggtaacttaacgttaaacggtgggttaacgggtaaccggttaccgggaaccggtaaaacgggggaacccgttaaaggggtaaacgaaaacgtacgtaaaacggttaccgttgggttacggtaacacggcctaaccggtacttacctcggttccttaaccg

SEQ ID NO: 442119 - DNA, 556 bp, Homo sapiens
  misc_feature: GZ8MTXP01A3H0J.2.7.A07.1.454.CMB.2.raw
  modified_base (198)..(198): a, c, t, g, unknown or other
  modified_base (266)..(266): a, c, t, g, unknown or other
  modified_base (410)..(410): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagttggtgatgacgcagtctccagccaccctgtctgtgtctccgaggggaaanacgccaccctctcctgcagggccagtcagagtattagcagcaacttagcctggtaccagcagaaaccnggccaggctcccaggctctcatcatgctgcatccaccagggcccacgtggtactcccagtcctaggttccaggtcggctaggtcggggtctgggggacaggtacgttcatttcacaccgatcagcagcctgcagtctagaagtntttgacttaatttattactgtacagtactaagtactaataacgtggtaggacgttcggaccgaaagggtaaccaaagggtaacgaaagtacgaaaacgttacgttggttacggtctacggcaccagttctaacggttctttaaccg

SEQ ID NO: 442120 - DNA, 546 bp, Homo sapiens
  misc_feature: GZ8MTXP01B72EH.2.7.A07.1.454.CMB.2.raw
  modified_base (197)..(197): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtattagcagcaacttagcctggtaccagcagaaacctggccaggctcccaggcctcncatctatgctgcatccaccagggccacgtggtactcccagccaggttcagtggcaggtgggtctgggactaggagttcattctacacatcagcacgcctgactagtactagaagttgttttagacttaaattttacttacttggttaccagtctaagtaataagtaacgtgggtacggacgttcgggaccgaaaggggtaccaaagggtagaaatacgaaacgacgttggagcttgaactaccattcttcgttctttaac

SEQ ID NO: 442121 - DNA, 518 bp, Homo sapiens
  misc_feature: GZ8MTXP01B5K5D.2.7.A07.1.454.CMB.2.raw
  modified_base (196)..(196): a, c, t, g, unknown or other
  modified_base (262)..(262): a, c, t, g, unknown or other
  modified_base (354)..(354): a, c, t, g, unknown or other
  modified_base (364)..(364): a, c, t, g, unknown or other
  modified_base (393)..(393): a, c, t, g, unknown or other
  modified_base (407)..(407): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaaccnggccaggctcccaggctcctcatctatgctgcatccaccgagggccactggtactcccagccaggttcagtgcagtgggtctggggacaggngttcagttcncaccatcagcagcctgccagtctgaagtntttgacttaatttnttactgtcagtcaagttaataattaacgtggtagtacgttcggcaaagggaccaaagggtacaaatacgaaacgaacgttgttacggctgcctaccattcgtcgttctttc

SEQ ID NO: 442122 - DNA, 587 bp, Homo sapiens
  misc_feature: GZ8MTXP01DW8JS.2.7.A07.1.454.CMB.2.raw
  modified_base (196)..(196): a, c, t, g, unknown or other
  modified_base (263)..(263): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccacctctcctgcagggccagtcagagtatagcagcaacttagcctggtaccagacaagaaaccnggaccaggcctccaggcctcctnatctatcgctgcactcccgacgacgggcctacgtcggtactcccgagtcccgtaggttccaggtcgggacctaggggttcggggttactgggggaactagggtacgtttccagtttccacgaccatcgagcagcctgactaggtctagtaagttatttgattaaattttattacgtgtacagtactaagtaattaaagtaagtggtaggtacgtacggacgtaaacgggacaaaggggtaacaaagtaacgtaaagacgttggttacgtaacgtagaacctactacttctcgttcttaacc

SEQ ID NO: 442123 - DNA, 568 bp, Homo sapiens
  misc_feature: GZ8MTXP01APU23.2.7.A07.1.454.CMB.2.raw
  modified_base (197)..(197): a, c, t, g, unknown or other
  modified_base (263)..(263): a, c, t, g, unknown or other
  modified_base (388)..(388): a, c, t, g, unknown or other
  modified_base (396)..(396): a, c, t, g, unknown or other
  modified_base (430)..(430): a, c, t, g, unknown or other
  modified_base (518)..(518): a, c, t, g, unknown or other
  modified_base (534)..(534): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtatagcagcaacttagcctggtaccagcagaaccnggaccaggctcccgaggcctcctcatctatgctgcactccaccgacgggcccagtcggtactcccgagcccgtaggttcaggtcggcagggtcggggtctggggactaggtacgttctattcccncaaccctntcgagcacgtcctggactaggttctagtaagttnttttagacttaaatttatactgttacagtactaagtataaagtacgtggtacggtacgttacggaccgaaagggaaccttaaaggtanaaacgtacgaaaacgngttaggttgctgaacacgtattctcgttctaacc

SEQ ID NO: 442124 - DNA, 539 bp, Homo sapiens
  misc_feature: GZ8MTXP01DE4BS.2.7.A07.1.454.CMB.2.raw
  modified_base (197)..(197): a, c, t, g, unknown or other
  modified_base (263)..(263): a, c, t, g, unknown or other
  modified_base (285)..(285): a, c, t, g, unknown or other
  modified_base (367)..(367): a, c, t, g, unknown or other
  modified_base (398)..(398): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcagaaaccnggccaggctcccaggcctcctnatctatgctgcatcccacgagggccacgtggtactcccagccaggttcagtggcaggtgggtctgggacagtagttcattcncaccatcagcagcctgctagtctagaagttntttgacttaaatttagttacttggtacagtctaagttaataaagtaacgtggtacggtacgttcggacgaaaggggtacaaagggtagaaatacgaaacgttagttggttacggctagccacgtattctaacgttcttaac

SEQ ID NO: 442125 - DNA, 587 bp, Homo sapiens
  misc_feature: GZ8MTXP01DMA46.2.7.A07.1.454.CMB.2.raw
  modified_base (197)..(197): a, c, t, g, unknown or other
  modified_base (260)..(260): a, c, t, g, unknown or other
  modified_base (278)..(278): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccacctctctgcagggccagtcagagtatagcagcaacttagcctggtaccagcagaaaccnggccagctccaggctccnatctatgctgcactcccaccagggcccacgtggtactcccgagccctaggttccaggtggcagggttgggtctgggggactagggtagttcagtttcacacctatcagcagcctgctagtctagaagttatttgacttaaattttattacttgtacaaggtctaagttaataaagttaacgtgggttacgggtaaccggtttcgggaaccggtaaaaggggtaaccttaaaggggtaaacaaaacgtacgaaaacgttaacgttggttacgggaactggaaccaacctagttcccttgttcctttaacc

SEQ ID NO: 442126 - DNA, 746 bp, Homo sapiens
  misc_feature: GZ8MTXP01BEML3.2.7.A07.1.454.CMB.2.raw
  modified_base (198)..(198): a, c, t, g, unknown or other
  modified_base (266)..(266): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcagaaaccnggccaggcctcccaggcctcctcatcctatcgctgcactccccaccgacggggccctacgtcgggtaacctccccgaggtcccgtaacgggtttccgaagggtcgggaccgtaggggttcgggggttccgttgggggaaccgtaagggtacggtttcctaacgtttccctactaaccctattaccgacggccgaacgtccccgttgaccgttacggttaccgttaggtaaaggttactttttacggacctttaaatttttacggttaacgtttacggttaacctaggttaaccttaaaggttaattaaacgtttaaaccggttggggttacgggtaaaccgggttttccggggaaaccgtaaaaggggggtaaacccttaaaaggggtaaacgttaaaacgttaccggtaaaaacgttaacggttggttacgggtaaccttggaaccctaaccctgttaccttcggttccctttaacccg

SEQ ID NO: 442127 - DNA, 547 bp, Homo sapiens
  misc_feature: GZ8MTXP01B6QMO.2.7.A07.1.454.CMB.2.raw
  modified_base (196)..(196): a, c, t, g, unknown or other
  modified_base (263)..(263): a, c, t, g, unknown or other
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggcctcctcatctatgctgcactccaccagggccactggtactcccagccaggttcagtggcaggtgggtctggggacagagttcattcncaccatcagcagcctgctagtctagaatatttgacttaatttattactgtcagctaagtactaagttacgtggtaggtacgttcggaccgtaaaggggaccaaagggtaacgaaagttaacgaaaacggttaacgttggacggtcttacggcctaaccgattcctaaggttcctttaaccg

SEQ ID NO: 442128 - DNA, 586 bp, Homo sapiens
  misc_feature: GZ8MTXP01DYGTA.2.7.A07.1.454.CMB.2.raw
  modified_base (196)..(196): a, c, t, g, unknown or other
  modified_base (262)..(262): a, c, t, g, unknown or other
  modified_base (282)..(282): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaccnggccaggctccaggctcctnatctatgctgcatccaccagggcccacgtggtactcccagcctaggttcaggtgcaggtggggtctggggacaggtagttcagttcctacaccatcagcagcctgacagtctagaagttntttgacttaattttattaactgtacagactaagttaataaagtaacgttgggtacggtacggttcgggacccgtaaaaggggtaacccttaaaggggttaaacgaaacgttaacgaaaaacggttaacgttgggttaacggtcttacggaaccaacccgtattacccgttgttccgtttaaccg

SEQ ID NO: 442129 - DNA, 585 bp, Homo sapiens
  misc_feature: GZ8MTXP01BTQ7K.2.7.A07.1.454.CMB.2.raw
  modified_base (199)..(199): a, c, t, g, unknown or other
  modified_base (265)..(265): a, c, t, g, unknown or other
  modified_base (286)..(286): a, c, t, g, unknown or other
  modified_base (374)..(374): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactgggagaagtggtgatgacgcagtctccagccaccctgtctgtgtctccgaggggaaanagccaccctctcctgcagggccagtcagagtattagcagcaacttagcctggtaccagcagaaacnggcaggcctccaggcctcctnatctatgctgcatccacagggccacgtggactccagcctaggttcaggtcggctaggtgggtctggggactaggtagtttcatttccncaacctatcaggtcacggtcctgaccgtagttcgtagtaagttattttagactttaatttttagttactggttacaggtactagtaattaagtaacgttgggtacggtaccgtttacgggacccgaaaggggtacaaagggtaagaaacgttacgaaaacgttaacgttggttagggcttacggctacctagttcctaacgttcttaaccg

SEQ ID NO: 442130 - DNA, 575 bp, Homo sapiens
  misc_feature: GZ8MTXP01CZQKE.2.7.A07.1.454.CMB.2.raw
  modified_base (196)..(196): a, c, t, g, unknown or other
  modified_base (260)..(260): a, c, t, g, unknown or other
  modified_base (279)..(279): a, c, t, g, unknown or other
  modified_base (415)..(415): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctccgaaggggaaancgccaccctctcctgcgagggccagtcagagtatagcagcaaattgcctaggaccagcagaacnggccaggctccagcctctnatctatgctgcactccacgaggccagtggactcccgagtaccgtaggttcaggtggcgtaggtcgggtctggggactagggtactttcaagtttctacaaccctatcgagacagcctggactaggtcagtaaagtnttttgaactttaatttagttacgtgtacagtactaaagtaataaagtaacgtgggtggtaaccgttcgggaaccgtaaaggggaaccaaaggggttaaaacaaacgtaaacgtaaaacgagttggttacgctacgaactactattccttcgttctaaccg

SEQ ID NO: 442131 - DNA, 522 bp, Homo sapiens
  misc_feature: GZ8MTXP01B8XAL.2.7.A07.1.454.CMB.2.raw
  modified_base (197)..(197): a, c, t, g, unknown or other
  modified_base (262)..(262): a, c, t, g, unknown or other
  modified_base (505)..(505): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcagaaccnggcaggctccagctcctcatctatgctgccatcccaccgagggccacgtggtactccagccaggttcaggtgcaggtgggtctgggacaggtagttcatttcacacatcagcagcctgcagtctagaagtatttgacttaattttatactgtacagtactagtaataagtaacgtgggtagtacgttcggacgaaagggcaaaggtacaaagtacgaaacgttacgttgacggctaggctacnttctaacgttcttaacg

SEQ ID NO: 442132 - DNA, 540 bp, Homo sapiens
  misc_feature: GZ8MTXP01D8VCZ.2.7.A07.1.454.CMB.2.raw
  modified_base (196)..(196): a, c, t, g, unknown or other
  modified_base (264)..(264): a, c, t, g, unknown or other
  modified_base (289)..(289): a, c, t, g, unknown or other
  modified_base (323)..(323): a, c, t, g, unknown or other
  modified_base (372)..(372): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagcaacttagcctggtaccagacaagaaaccnggaccaggcctcccgaggcctcctnatctatgctgcatcccacgaggcccagtcgtacncccagcctaggttcaggtgctaggtgggtctggggacagtgttcattcncacatcagcagcctgacagtcagtaagttntttgacttaatttagtactgtacagtactaagttataaagtacgtgggtacgtacgttcggaaccgtaaagggacttaaagggtaacaaagtacgaaaacgagttggaggtcagaacctactattctcgttcttaacg

SEQ ID NO: 442133 - DNA, 531 bp, Homo sapiens
  misc_feature: GZ8MTXP01BJSL4.2.7.A07.1.454.CMB.2.raw
  modified_base (196)..(196): a, c, t, g, unknown or other
  modified_base (262)..(262): a, c, t, g, unknown or other
  modified_base (366)..(366): a, c, t, g, unknown or other
  modified_base (388)..(388): a, c, t, g, unknown or other
  modified_base (394)..(394): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaaccnggccaggctcccaggcctcctcatctatgctgcatcccacgagggccacgtggtactcccagccaggttcagtggcaggtgggtctggggacagagttcattcncaccatcagcagcctgcagtcngaagtntttgactaatttatactgtacagctaagtataataacgtggtaggtacgttcggaccgaaagggtaccgaaagggttaacgaaacgtaacgaaaacgttaacgttggttaggctagcaaccattcctgttccttaac

SEQ ID NO: 442134 - DNA, 530 bp, Homo sapiens
  misc_feature: GZ8MTXP01DICPD.2.7.A07.1.454.CMB.2.raw
  modified_base (196)..(196): a, c, t, g, unknown or other
  modified_base (260)..(260): a, c, t, g, unknown or other
  modified_base (281)..(281): a, c, t, g, unknown or other
  modified_base (316)..(316): a, c, t, g, unknown or other
  modified_base (486)..(486): a, c, t, g, unknown or other
  modified_base (520)..(520): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctccgaaggggaaanagccacctctctgcagggccagtcagagtatagcagcaacttagcctggtacagacagaaaccnggccaggctccgaggctcctnatctatgctgcactccacgagggccacgtggtacnccgagccgtaggttcagtgcgtaggtgggtctggggactagggtacttcattctacaccatcagcacgcctgtactagtcgtagaagttactttagacttaaatttatacttgtaacagtctaagtaataagtaacgtggtacgacgttcgaacgaagggacaaggtaanaaagtacgaaattacgttgttagctgaactactnttctcttctc

SEQ ID NO: 442135 - DNA, 527 bp, Homo sapiens
  misc_feature: GZ8MTXP01EJVO3.2.7.A07.1.454.CMB.2.raw
  modified_base (196)..(196): a, c, t, g, unknown or other
  modified_base (263)..(263): a, c, t, g, unknown or other
  modified_base (346)..(346): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggctcctcatctatgctgcatccacagggccatgatcccagccaggttcagtgcagtgggctgggacagngttcattctcaccatcagcagcctagcagtctagaatatttgactaatttattactgtacagtcaagtataataacgtgggtagtacggttcggaccgaaagggtacccaaaggggttaaacaaagtacgaaaacgttacgttggttacggctagaacctaactacttcgttcgtttcctc

SEQ ID NO: 442136 - DNA, 567 bp, Homo sapiens
  misc_feature: GZ8MTXP01A0NBG.2.7.A07.1.454.CMB.2.raw
  modified_base (197)..(197): a, c, t, g, unknown or other
  modified_base (264)..(264): a, c, t, g, unknown or other
  modified_base (531)..(531): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcaagaaaccnggccaggcctcccgaggcctcctcatctatcgctgcactcccaaccgacgggcccacgtggtactcccgagcctaggttcaggtggcaggtgggtctggggactaggtagttcagttcacgacctatcagcagcctgaccagttctaggaacttattttcgacttaatttacttacgtagtacaggtactaagttaacttaagtaacgttggtacggtacgttcggacgtaaagggacaaagggtaacaaagtacgaaacgttacgnggttacgctcggaacacgtagttcctcgttcttaac

SEQ ID NO: 442137 - DNA, 555 bp, Homo sapiens
  misc_feature: GZ8MTXP01BB5GC.2.7.A07.1.454.CMB.2.raw
  modified_base (197)..(197): a, c, t, g, unknown or other
  modified_base (262)..(262): a, c, t, g, unknown or other
  modified_base (281)..(281): a, c, t, g, unknown or other
  modified_base (498)..(498): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttgcctggtaccagcagaaaccnggccaggctccaggctccncatctatgctgcatccaccagggccactggtactcccagccaggtcaggtggctaggtcgggtctggggacaggtacgttcaagtttcctacaccctatcaggcaggccttgactagtctagaaagttattttgacttaaattttacttacgtgttacaggtctaagtataataacgtggtaggtaccgttcggacgaaagggacttaaagggtaanaaacgtaccgtaaaagacgttggttacgaactcgaacaccgattcgtgttcttaacc

SEQ ID NO: 442138 - DNA, 527 bp, Homo sapiens
  misc_feature: GZ8MTXP01D6OIJ.2.7.A07.1.454.CMB.2.raw
  modified_base (197)..(197): a, c, t, g, unknown or other
  modified_base (265)..(265): a, c, t, g, unknown or other
  modified_base (287)..(287): a, c, t, g, unknown or other
  modified_base (319)..(319): a, c, t, g, unknown or other
  modified_base (365)..(365): a, c, t, g, unknown or other
  modified_base (393)..(393): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaaccnggccaggctcccaggcctcctnatctatgctgcatccacgagggccatggtacnccagccagttcagtgcaggtgggtctggggacagtacgttcattcncaccatcagcagcctgcagtctgaagtntttgacttaatttatactgtactagactaagtaataagttaacgtgggtggtacgttcggaccgaaagggtacccaaagggtacaaagtacgaaaacgaacgttggaggctgaacactattcctgttcttaacc

SEQ ID NO: 442139 - DNA, 640 bp, Homo sapiens
  misc_feature: GZ8MTXP01BUY5Z.2.7.A07.1.454.CMB.2.raw
  modified_base (199)..(199): a, c, t, g, unknown or other
  modified_base (267)..(267): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaancgccaccctctcctgcagggccagtcagagtatagcagcaacttagcctggtaccagacacgaaaccnggacccccccccccccaggcctcccgacggcctcctcatctatgctcgcactccaccgacgggccacgtcggtactcccacgccgtacggttcgagtggcgaggtgggtcgtggggacgagtagttctattctcacctatcacgcacgcctcgactagtcgtagtaagttatttagtacttaatttacgtttacttacgtactagtactaagttaataagttaaacgttgggttacgggtaccggttaccgggaaccggtaaacggggaaaccggttaaacgggtaaagttaaaacgtaaaccgtaaaacggttaaacgttggttacggtaacgtacggaaccgtaacctacttacgttcgttcgtttaaccg

SEQ ID NO: 442140 - DNA, 577 bp, Homo sapiens
  misc_feature: GZ8MTXP01A0UZB.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagatatagcagcaacttagcctggtaccagcagaacctggccaggctccaggctcctcatctatgctgcatcccaccgagggcccactggtactcccgagccaggttcaggtggcgaggtgggtctgggacaggtagttcattctcaccatcagcagcctgaccagtctagtaagttattttgacttaatttacttacgtgttcaaggtctaagttataagttaacgtgggtacggtacggttcggaaccgaaaggggtaaccttaaagggtaaacgaaacgttaaccgaaaacggaacgttggttacgggtaaccttaggcctaaccctattccgttcggtttccttttaaccg

SEQ ID NO: 442141 - DNA, 618 bp, Homo sapiens
  misc_feature: GZ8MTXP01APZJW.2.7.A07.1.454.CMB.2.raw
  modified_base (198)..(198): a, c, t, g, unknown or other
  modified_base (208)..(208): a, c, t, g, unknown or other
  modified_base (262)..(262): a, c, t, g, unknown or other
  modified_base (607)..(607): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaangcccaccctntcctgcagggccagtcagagtatagcagcaattgcctggtaccagcagaaaccnggccaggctcccaggctcctcatctatgctgcatcccaccgagggcccaacgtcggtaactccccgaagccccgtaaggtttccaggttgggaccaggggttcggggttccgtgggggtaaccaagggtacgtttcaacttttccacaaccctattcaaacggccaacggcccttggacctaaggttcctagggtaaagttattttttaggactttaaattttacgtttaacgttggttaccaggtactaagttaataaacgttaacgtgggtacggtacgttacgggacctaaaggggaccaaagggtaacaaatacgaaagacgttggttggaactgaacacnttctgttctaa

SEQ ID NO: 442142 - DNA, 618 bp, Homo sapiens
  misc_feature: GZ8MTXP01EP27J.2.7.A07.1.454.CMB.2.raw
  modified_base (198)..(198): a, c, t, g, unknown or other
  modified_base (264)..(264): a, c, t, g, unknown or other
  modified_base (560)..(560): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagcaacttagctggtaccagcaagaaccnggccaggctccaggctcctcatctatcgctcgacactccaccgaacgggccctaacgtggtactcccgagcccgtaaggtttcaggtggacagggttcggggtactgggggactaagggtagtttccatttccacaaccctataccgaacggcaacggcccttgacctagttactaggtaattagttttagaacttaaattttaacgggtttacttggtacaacggtactaagttaattaaagtaacgtgggtaggtaccgttacggaaccgtaaaggggaccttaaagggtaaanaaatacgaaaacgacgttggttacgggctcggaacacctattccttgttccgttaacc

SEQ ID NO: 442143 - DNA, 545 bp, Homo sapiens
  misc_feature: GZ8MTXP01ENQSP.2.7.A07.1.454.CMB.2.raw
  modified_base (197)..(197): a, c, t, g, unknown or other
  modified_base (262)..(262): a, c, t, g, unknown or other
  modified_base (281)..(281): a, c, t, g, unknown or other
  modified_base (287)..(287): a, c, t, g, unknown or other
  modified_base (299)..(299): a, c, t, g, unknown or other
  modified_base (312)..(312): a, c, t, g, unknown or other
  modified_base (349)..(349): a, c, t, g, unknown or other
  modified_base (357)..(357): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaacnggccaggctccaggctctnatctangctgcatccacngggccagtgtacncccgagccaggttcagtgcaggtgggtctgggacagntccattcncaccatcgagcagcctgcctagtctaggaattatttgacttaaatttagttaactgttacagactaagtaataagtaacgtgggtagtacggttcggaccgaaaaggggtacaaaggggtacaaaacgtacgaaaacgttagttcggaggtcctgaaccctaccgtattccgttaaggttcttaaccg

SEQ ID NO: 442144 - DNA, 554 bp, Homo sapiens
  misc_feature: GZ8MTXP01C1JFV.2.7.A07.1.454.CMB.2.raw
  modified_base (196)..(196): a, c, t, g, unknown or other
  modified_base (265)..(265): a, c, t, g, unknown or other
  modified_base (288)..(288): a, c, t, g, unknown or other
  modified_base (379)..(379): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttagcctaggtaccagcaagaaaccnggccaggctacccgaggctcctnatctatgctgcatcccaccagggccacgtggtactcccgagcctaggttccaggtggctaggtcgggtactggggacaggtagttcattcncaccatcagcagcctgactagtctaggaatatttagacttaaattttagtaactggttacagtactaagttaataaagttaacgtgggtacgtacgttcggacgtaaagggacaaaggtaagaaactaacgaagaacgttggttacggctgaactacgtattcttgttctttaac

SEQ ID NO: 442145 - DNA, 519 bp, Homo sapiens
  misc_feature: GZ8MTXP01D1VVS.2.7.A07.1.454.CMB.2.raw
  modified_base (266)..(266): a, c, t, g, unknown or other
  modified_base (374)..(374): a, c, t, g, unknown or other
  modified_base (479)..(479): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaaacttagcctggtaccagcaagaaaccnggccaggcctcccgaggctcctcatctatgctgcatccaccagggcccatggtactcccagcctaggttcaggtggcaggtgggtctggggacaggtacgttcattcncacatcagcagcctgcagtctaggaatatttgacttaaattttattacttgtacagtactagtataatacgtggtaggacgttcggacaaagggacaaggttaanaaatacgaaacgagttgttaggctgcacattctgttcttc

SEQ ID NO: 442146 - DNA, 572 bp, Homo sapiens
  misc_feature: GZ8MTXP01DA40B.2.7.A07.1.454.CMB.2.raw
  modified_base (196)..(196): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaangccaccctctcctgcagggccagtcagagtatagcagcaacttgcctggtaccagcaagaaaccgnggccaggcctcccgaggtcctcctcatcctatcgctcgcactcccaccgacgggccctaacgttggtactcccgagccgtaggttcaggtggcgtaggtcggggtctgggggactaggtacgttcatttcacacctatcagcagcctaggactagttctagtaagttatttgaacttaattttacttactgtacagtactaagttaataagtaacgtggtcggtacgttcggacgtaaagggacaaaggtaacgaaagtaacgaaagttacgttggacggctacgctacgtattcgttcgttctttaacc

SEQ ID NO: 442147 - DNA, 620 bp, Homo sapiens
  misc_feature: GZ8MTXP01BM1SL.2.7.A07.1.454.CMB.2.raw
  modified_base (199)..(199): a, c, t, g, unknown or other
  modified_base (268)..(268): a, c, t, g, unknown or other
  modified_base (438)..(438): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaanacgccaccctctcctgcagggccagtcagagtattagcagcaacttagcctggtaccagcaagaaaccnggccaggcctcccaggtcctcctcatctatgctgcatcccaccgacgggcctacgtcggtactcccaggtcctaaggttcaggtggctagggtcggtcgtggggaacaggtacgttctactttcaccgacctatcgagtccacgcctggacctaggtctaggtaagtttnttacgtacttaatttcgtcgtcgttgtacagtacttaagttaattaaacgttacggttgggttacggtacggttaccgggaaccggtaaacgggttaacgtaaaagggttaaacgtaaaacgtaacgttaaaacggttcgttacggtcggactaacgaccctacgttacgttccgttcgtcc

SEQ ID NO: 442148 - DNA, 612 bp, Homo sapiens
  misc_feature: GZ8MTXP01ARWLW.2.7.A07.1.454.CMB.2.raw
  modified_base (197)..(197): a, c, t, g, unknown or other
  modified_base (261)..(261): a, c, t, g, unknown or other
  modified_base (282)..(282): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttgcctggtaccagcaagaaccnggccaggctcccaggcctccncatctatcgctgcactcccgaccgagggcccacgtggtactcccgagtcccgtaggttcaggtggcgtaggtcgggtctggggaactaggtagttcagtttcacacatcgagcacgtcctgactaggttctaggaagttacttttgaactttaaattttataacttggtacaaggtactaagttaacttaaagtaacggtggggtacggtacggttaccggaacgtaaacggggtaaccttaaagggtaaacgttaaacgtaaccgtaaaacgttacgttgggttacggaactacggaacctaacctattcgttaacgttcctttaaccg

SEQ ID NO: 442149 - DNA, 513 bp, Homo sapiens
  misc_feature: GZ8MTXP01BRGXR.2.7.A07.1.454.CMB.2.raw
  modified_base (196)..(196): a, c, t, g, unknown or other
  modified_base (206)..(206): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctntcctgcagggccagtcagagtattagcagcaacttagcctggtaccagcagaaaccnggccaggctcccaggctcctcatctatgctgcatccaccagggccactggtactcccagccaggttcagtggcagtgggtctggggacagagttcattatcaccatcagcagcctgcagtctgaagtatttgactaatttattaactgttcagtcaagtataataacgtggtggtacgttcggccaaagggccaaagggtacgaaagtcgaaaacgaagttgttacggctgcactagttctgttcttaac

SEQ ID NO: 442150 - DNA, 508 bp, Homo sapiens
  misc_feature: GZ8MTXP01A156S.2.7.A07.1.454.CMB.2.raw
  modified_base (196)..(196): a, c, t, g, unknown or other
  modified_base (262)..(262): a, c, t, g, unknown or other
  modified_base (471)..(471): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaccnggccaggctccaggctcctcatctatgctgcatcccaccagggccacgtggtactcccagccaggttcagtggcaggtgggtctggggacaggtagttcattctacaccatcagcacgcctgactagtctagaagtatttgacttaatttacgttactgtacagtacaagtataatacgtggtgtacgttcggacaagggacaaggtanaaagtcgaaacgacttgagctgcacattctgttcttc

SEQ ID NO: 442151 - DNA, 575 bp, Homo sapiens
  misc_feature: GZ8MTXP01BID28.2.7.A07.1.454.CMB.2.raw
  modified_base (196)..(196): a, c, t, g, unknown or other
  modified_base (262)..(262): a, c, t, g, unknown or other
  modified_base (317)..(317): a, c, t, g, unknown or other
  modified_base (349)..(349): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagcaacttagcctggtaccagcaagaaccnggccaggctccagctcctcatcatgctgacactccaccgagggccacgtggtacncccagcctaggttcagtcggcaggtcgggtcnggggactagggtacgttcacttctaccgactatcagcagtccctgacctagtctagtaagttatttagacttaatttacttacgttgtacagtactaagtaataagttaagttggtagggtacgttcgggaacgaaaggggtaacccttaaaggggtaaacaaagtaccgaaaacgttacggttggttacgggctaggaacctaccagttcgttcgttccttaacc

SEQ ID NO: 442152 - DNA, 538 bp, Homo sapiens
  misc_feature: GZ8MTXP01C13VB.2.7.A07.1.454.CMB.2.raw
  modified_base (197)..(197): a, c, t, g, unknown or other
  modified_base (263)..(263): a, c, t, g, unknown or other
  modified_base (285)..(285): a, c, t, g, unknown or other
  modified_base (319)..(319): a, c, t, g, unknown or other
  modified_base (336)..(336): a, c, t, g, unknown or other
  modified_base (379)..(379): a, c, t, g, unknown or other
  modified_base (386)..(386): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaanagccaccctctcctgcagggccagtcagagtatagcagcaaacttgcctaggaccagcagaaaccnggccaggctcccaggctcctanatctatgctgcactccacgacggccacgtgtacnccagctacgtcagtcgngagtggtcgtggagagtagtctactctacacacacagcacgcngacagtntagtagtattatataattagttatagtatagataagtaataagtaagtaggtaggtacgtacggaacgaacggaacgaaaggtaaagaaacgtaaacgtaaacgttaacgttagttacgtaacgtacgtaacactacttacttcgttcgttc

SEQ ID NO: 442153 - DNA, 563 bp, Homo sapiens
  misc_feature: GZ8MTXP01CLUFJ.2.7.A07.1.454.CMB.2.raw
  modified_base (198)..(198): a, c, t, g, unknown or other
  modified_base (262)..(262): a, c, t, g, unknown or other
  modified_base (280)..(280): a, c, t, g, unknown or other
  modified_base (504)..(504): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgcccaccctctctgcagggccagtcagagtatagcagcaacttgcctggtaccagcagaaccnggcaggctccagctcctnatctatcgctgcactcccgaaccgaggggccccaagttcggtactcccccgagtcccgtagggtttcagggtggcctaggtcggggtctgggggacaggtgtttcagtttcacacctatcaggcagcctgactagtctagaagttatttgacttaattttgtactggtacagtctaagttataatacgtggtagtacgtcggacgaaagggacttaaagggtanaaacgttcgaaaacgttcgttggttcgaatcggtaaccacgtattcctgttaacctttc

SEQ ID NO: 442154 - DNA, 533 bp, Homo sapiens
  misc_feature: GZ8MTXP01DYZYX.2.7.A07.1.454.CMB.2.raw
  modified_base (196)..(196): a, c, t, g, unknown or other
  modified_base (287)..(287): a, c, t, g, unknown or other
  modified_base (485)..(485): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanacgccaccctctcctgcagggccagtcagagtattagcagcaacttagcctggtaccagcaagaaacctggccaggctcccaggcctcctnatctatgctgcatccacgagggccacgtgtactccgagcctaggttcaggtggctaggttcgggttctggggactaggtagtttcattctcacctatcagcagcctgactagtctagtaagtatttgacttaattttattactgtacagtctaagtataataacgtggtagtacgttcggacaaagggacaaaggtanaaagtacgaaacgttacgttgttaggctgcacattccttgttcttaac

SEQ ID NO: 442155 - DNA, 511 bp, Homo sapiens
  misc_feature: GZ8MTXP01AY3J1.2.7.A07.1.454.CMB.2.raw
  modified_base (263)..(263): a, c, t, g, unknown or other
  modified_base (364)..(364): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaaccnggccaggctcccaggctcctcatctatgctgcatcccaccagggcccatggactcccagccaggttccagtggcagtgggtctgggacagagttcatttcncaccatcagcagcctgcagtctgaagtatttgactaatttagttactgtcagctaagtataataacgtggtggtacgttcggctaaaggggaacaagggtaacgaaatacaaacgacgttgttaggctgcaccgtattctgttcttc

SEQ ID NO: 442156 - DNA, 658 bp, Homo sapiens
  misc_feature: GZ8MTXP01CETSC.2.7.A07.1.454.CMB.2.raw
  modified_base (196)..(196): a, c, t, g, unknown or other
  modified_base (452)..(452): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanacgcccaccctctcctgcagggccagtcagagtatagcagcaacttagcctggtaccagcaagaaacctggaccaggcctcccgaggcctcctcatctatcgctgccactcccgaccgacgggccacgttcggtacctcccgagtccgtacggttcgaggtggctagggtcggggtcgtggggactaggtacgttcagtttccacaaccctatcgagccacggtccctaggactacggttacgtaggtaaacgttntttttacggactttaaagttttactttacgttgttacctaaggtacttaaagttaattaaacgtttacggtgggtacggggtaaccggtttacgggaacccggtaaaggggtaaccttaaagggggtaaacaaaacgttaacgaaaacgggttacgttgggttacgtaactacggaacctactacgttctaaccggttctttaacc

SEQ ID NO: 442157 - DNA, 636 bp, Homo sapiens
  misc_feature: GZ8MTXP01BGNJU.2.7.A07.1.454.CMB.2.raw
  modified_base (197)..(197): a, c, t, g, unknown or other
  modified_base (262)..(262): a, c, t, g, unknown or other
  modified_base (441)..(441): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcagaaccnggccaggcctcccgaggcctcctcatctatgctgcactcccaccgacgggccctacgtggtacctcccaggcccgtaggttccaggttggcgtagggttcggggtctgggggactagggtacgttcaagtttccacaccctatcgaagcacggccttgacgtagttctagggtaaattnttttagactttaaattttacttaacgttggtacctaggtactaagttaacttaaacgttaacggttggggtaacggtacggttaccgggaaccgtaaagggggtaaccttaaaggggttaaacaaacgttaacgaaaacggttaacgttgggttacggcttacggcctaactattccgtttcgttcctttaaccg

SEQ ID NO: 442158 - DNA, 588 bp, Homo sapiens
  misc_feature: GZ8MTXP01EJ536.2.7.A07.1.454.CMB.2.raw
  modified_base (196)..(196): a, c, t, g, unknown or other
  modified_base (383)..(383): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagcaacttagcctggtaccagcaagaaacctggaccaggcctcccgaggcctcctcatctatgctgcactcccacgacgggccacgtggtactcccagcctaggttccaggtcggcagggttcgggtctggggactaggtagttcatttcncaccatcagcagcctgacagttctagtaagtatttgacttaatttttacgttacttgtacagtactaagttaattaaacgttaacgttgggtcggtaaccggtttcgggaaccgtaaaggggaccttaaaggggtaaacgttaaaacgtacgaaaacgacgttggttacggctaggaacctaccgattccgttcgttctttaacc

SEQ ID NO: 442159 - DNA, 574 bp, Homo sapiens
  misc_feature: GZ8MTXP01EH5BG.2.7.A07.1.454.CMB.2.raw
  modified_base (197)..(197): a, c, t, g, unknown or other
  modified_base (561)..(561): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctaggtaccagcaacgaaacctggaccaggcctacccgaggcctcctcattcctatcgctcgctactcccaccgacgggccctacgtcggtactcccgagccgtaacggttcaggtcggcagggtcgggtctgggggactaggtacgttcagtttcacacatcgagcagcctgactagtctaggaagttatttgaacttaattttattacgttgtacagtactaagttaataagtaacgtggtagtacgttcggacgaaagggtacaaagggtaacaaagtacgaaacgttacgttggttacggctgaacctacgtnttactgttcttcc

SEQ ID NO: 442160 - DNA, 556 bp, Homo sapiens
  misc_feature: GZ8MTXP01ES4G6.2.7.A07.1.454.CMB.2.raw
  modified_base (196)..(196): a, c, t, g, unknown or other
  modified_base (348)..(348): a, c, t, g, unknown or other
  modified_base (410)..(410): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtattagcagcaacttagcctggtaccagcaagaaaccgtggccaggcctcccgaggcctcctcatctatcgctgcactcccaccgacgggccacgtggtactcccagcctaggtcagtgcnggtgggtctgggacagtattcattcacaccatcagcacgcctgactagttctaggtaagttnttttgacttaatttattacgtgtacagtactaagttaataagttacgtgggtcggtacgttcggacgaaagggtacgaaaggtaaacgaaagtaccgaaaacgttacgttgggttacgctacgaacacctattcttcgtttcgtcc

SEQ ID NO: 442161 - DNA, 536 bp, Homo sapiens
  misc_feature: GZ8MTXP01B2PKN.2.7.A07.1.454.CMB.2.raw
  modified_base (197)..(197): a, c, t, g, unknown or other
  modified_base (426)..(426): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagcaacttagcctggtaccagcagaaacctggccaggctcccaggcctcctcatctatgctgcactccaccagggccactggtactcccagccaggttcagtggcaggtgggtctggggacaggtattcatttcacaccatcagcagcctgcagtctagaagtatttgactaattttagtactgtacaganagtaataataataggtaggtacgttcggacgaaacgggaacgaaaggtaaaggaaagtaaacaaacgaacgttagttaggtaacgtgaacaccattactcgttcgtttcc

SEQ ID NO: 442162 - DNA, 652 bp, Homo sapiens
  misc_feature: GZ8MTXP01B8G0D.2.7.A07.1.454.CMB.2.raw
  modified_base (197)..(197): a, c, t, g, unknown or other
  modified_base (265)..(265): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcaagaaaccnggccaggcctcccgaggcctcctcatctatcgctgccactcccaccgagggccctacgtcggtactcccagcctaggttcaggtcggctagggtcgggtctgggggaactagggtacgtttcgaatttccgtacaccctattccgagccgtacggccctgacgtacgttctagggtaaattagtttttacgaacttaaagtttttaacttacgttcggtaccaaggtactaaaggttaattaaagttaacggttgggttacgggtaccgttaccgggaaccgtaaacgggggtaaaccgttaaagggtaaacgaaacgttaaaccgaaaacggttacgttggttacggaactacggtaaccaactgttaccttaagttcctttaacc

SEQ ID NO: 442163 - DNA, 599 bp, Homo sapiens
  misc_feature: GZ8MTXP01CRNUN.2.7.A07.1.454.CMB.2.raw
  modified_base (197)..(197): a, c, t, g, unknown or other
  modified_base (265)..(265): a, c, t, g, unknown or other
  modified_base (287)..(287): a, c, t, g, unknown or other
  modified_base (421)..(421): a, c, t, g, unknown or other
  modified_base (522)..(522): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaanacgccaccctctcctgcagggccagtcagagtatagcagcaacttgcctaggtaccagcaagaaaccnggccaggcctccgaggctcctnatctatgctgcactcccacgagggccacgtcggtactcccgagcctaggttcaggtggcgtaggtcgggtactggggaactaggtacgtttcaatttcacacctatcagcacgcctgactagtctagtaagttntttacgacttaattttatacgtgttacagtactaagtaataaacgttacggttgggtacggtacgttcggaaccgtaaacgggaaccgttaaagggtaaanaaacgtaaaccgtaaaacggacgtttacgggacggtaactacggaacctacctattccgttcgttccgtttaacccg

SEQ ID NO: 442164 - DNA, 519 bp, Homo sapiens
  misc_feature: GZ8MTXP01D7MSO.2.7.A07.1.454.CMB.2.raw
  modified_base (198)..(198): a, c, t, g, unknown or other
  modified_base (265)..(265): a, c, t, g, unknown or other
  modified_base (320)..(320): a, c, t, g, unknown or other
  modified_base (335)..(335): a, c, t, g, unknown or other
  modified_base (342)..(342): a, c, t, g, unknown or other
  modified_base (358)..(358): a, c, t, g, unknown or other
  modified_base (406)..(406): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaaaccnggccaggctcccaggctcctcatctatgctgcatccaccagggccactggtaacnccagcagtcagtgcngtggtcnggacagtattcattcncacatcagcagctgcagtctagagtattatataatttaagttactgtntagatagtaataataaacgtaggtaggtacggtacggacggaacggaaacgaaaggtaaagaaagtaaacgtaaacgaacgttagttagtgtgaacacacttactcgttcgtc

SEQ ID NO: 442165 - DNA, 547 bp, Homo sapiens
  misc_feature: GZ8MTXP01B2C58.2.7.A07.1.454.CMB.2.raw
  modified_base (261)..(261): a, c, t, g, unknown or other
  modified_base (281)..(281): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttgcctggtaccagcagaaccnggccaggctccaggctcctnatctatgctgccactcccaccgagggcccacgtcggtactcccagccaggttcaggtggcaggtggggtctgggggactagggtacgttcatttctacacctatcagcacgtcctgctagtctagtaagttattttgactttaattttacttacttggtcagtactaagtactaagttacgtgggtacggtacgttcggaccgaagggaacaagggtaagaaatacgaaagttacgttggttcgctgctacgtattctgttccttc

SEQ ID NO: 442166 - DNA, 547 bp, Homo sapiens
  misc_feature: GZ8MTXP01DNGTA.2.7.A07.1.454.CMB.2.raw
  modified_base (198)..(198): a, c, t, g, unknown or other
  modified_base (373)..(373): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngccaccctctcctgcagggccagtcagagtattagcagcaacttgcctggtaccagcaagaaacctggccaggcctcccaggcctcctcatctatgctgcatcccacgagggccacgtggtactcccgagcctaggttcagtggctaggtgggtctggggacaggtattcattcncaccatcagcagcctgacagtctagaagtatttgacttaatttattacttgtacagtactaagtataagtaacgtgggtacggtacggttcggacaaaggggtaccaaagggtaacgaaagttacgaaacgttacgttggttacggctagccaactagttctcgttcttaaccg

SEQ ID NO: 442167 - DNA, 568 bp, Homo sapiens
  misc_feature: GZ8MTXP01DXKG5.2.7.A07.1.454.CMB.2.raw
  modified_base (199)..(199): a, c, t, g, unknown or other
  modified_base (265)..(265): a, c, t, g, unknown or other
  modified_base (519)..(519): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaaggggaaancgccaccctctcctgcagggccagtcagagtatagcagcaacttgcctggtaccagcaagaaaccnggaccaggcctccaggcctcctcatctatgctgcactcccaccgacgggccctacgtcggtactcccgagcctaacggttcaggtcggctagggtcgggtcgtgggggactaggtacgtttcacgtttccacgaccctatccaagcagccctgacctagttctagtaagttactttgacttaattttagttacttgtacagtctaagtaataaagtacgtgggtggtacgttcggacgtaaaggacaaaggtanaaacgtacgaagttacgttgttgctagccacgtattctcgttcttaacc

SEQ ID NO: 442168 - DNA, 573 bp, Homo sapiens
  misc_feature: GZ8MTXP01BUBJ1.2.7.A07.1.454.CMB.2.raw
  modified_base (198)..(198): a, c, t, g, unknown or other
  modified_base (263)..(263): a, c, t, g, unknown or other
  modified_base (284)..(284): a, c, t, g, unknown or other
  modified_base (372)..(372): a, c, t, g, unknown or other
  modified_base (392)..(392): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaaccnggccaggctcccaggctcctnatctatgctgcatccacagggccacgtgtactcccagccaggttcagtggcaggtgggtctggggacagagttcattctcaccatcancagcctgcagtctagaagtntttgacttaatttacttactgtactagtactaagtattaaagttaacgtgggtacggtaccgttacgggaccgtaaaggggaacccttaaaagggttaacgaaaacgttaaccgaaaacggttaacgttggttacggaacttacggaacctaacccgattacgttcgttaactttaacccg

SEQ ID NO: 442169 - DNA, 572 bp, Homo sapiens
  misc_feature: GZ8MTXP01E3FL9.2.7.A07.1.454.CMB.2.raw
  modified_base (197)..(197): a, c, t, g, unknown or other
  modified_base (253)..(253): a, c, t, g, unknown or other
  modified_base (262)..(262): a, c, t, g, unknown or other
  modified_base (434)..(434): a, c, t, g, unknown or other
  modified_base (517)..(517): a, c, t, g, unknown or other
  modified_base (559)..(559): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgcagggccagtcagagtatagcagcaacttgcctggtaccngcagaaccngccaggctccaggctcctcatctatgctgcatcccaccgagggcccacgtggtactcccgagcccgtaaggttccaggtggaccgtaggttcggggtcgtggggactagggtagtttccatttcctacaaccctagtcaggcagtcccgtagacctagttctaggtaaattnttttagacttaaatttacgttactgtacagactagtataagtacgtggtcggtacgttcggacgtaaagggaacaagggtaanaaacgtaacgaacgacgttggttcgaactagaacctaccgtnttactcgttctcc

SEQ ID NO: 442170 - DNA, 549 bp, Homo sapiens
  misc_feature: GZ8MTXP01BMTK2.2.7.A07.1.454.CMB.2.raw
  modified_base (262)..(262): a, c, t, g, unknown or other
  modified_base (374)..(374): a, c, t, g, unknown or other
  modified_base (405)..(405): a, c, t, g, unknown or other
  modified_base (488)..(488): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaagcgccaccctctcctgcagggccagtcagagtatagcagcaacttagcctggtaccagcagaaaccnggccaggcctcccaggcctcctcatctatgctgcatcccacgacgggccacgtggtactcccgagcctaggttcaggtggctaggtgggtctggggacaggtagttcattcncaccatcagcagcctggacagtctagaagtntttgacttaatttattactgtacagtctaagtactaagtaacgtgggtacgtacgttcggacgaaaggggtaccaaagggtanaaacgtacgaaacgttacgttggttcgggcttggaacctacgattcttaagttcttaaccg

SEQ ID NO: 442171 - DNA, 571 bp, Homo sapiens
  misc_feature: GZ8MTXP01C82YM.2.7.A07.1.454.CMB.2.raw
  modified_base (196)..(196): a, c, t, g, unknown or other
  modified_base (263)..(263): a, c, t, g, unknown or other
  modified_base (285)..(285): a, c, t, g, unknown or other
  modified_base (450)..(450): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctctgcagggccagtcagagtatagcagcaacttagcctggtaccagcaagaaaccnggccaggctcccaggcctcctnatctatgctgcactcccaccgagggccacgtggtactcccagtccctaggttccaggtggctagggtcgggtctgggggactagggtaacgttcagttccacaccatcagcagcctgacctagtctagtaagttatttagacttaatttattaacgtgtacagtntaataataataacgtggtacggtacgtcggaaccgtaaaggggaaccttaaagggtaacaaaacgttacgaaaacgttaacgttggacggtctacgaactaccgattcgtcgttccttaac

SEQ ID NO: 442172 - DNA, 551 bp, Homo sapiens
  misc_feature: GZ8MTXP01DEC0L.2.7.A07.1.454.CMB.2.raw
  modified_base (196)..(196): a, c, t, g, unknown or other
  modified_base (262)..(262): a, c, t, g, unknown or other
  modified_base (285)..(285): a, c, t, g, unknown or other
  modified_base (321)..(321): a, c, t, g, unknown or other
  modified_base (368)..(368): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttgcctggtaccagcaagaaccnggccaggcctcccaggcctcctnatctatgctgcatcccaccgagggccacgtggtacnccagcctaggttcagtggcaggtgggtctgggacagtagttcattcncacatcagcagcctgctagtctagtaagtatttgacttaaattttattacgttgtacagtactaagttaataagtaacgtgggtacggtacgttcgggacgtaaaggggaccaaagggtaagaaacgttacgaaaacgttaacgttggacggtctagcctaacgattccgtgttccttaaccg

SEQ ID NO: 442173 - DNA, 657 bp, Homo sapiens
  misc_feature: GZ8MTXP01B7DNV.2.7.A07.1.454.CMB.2.raw
  modified_base (197)..(197): a, c, t, g, unknown or other
  modified_base (359)..(359): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctaccgaaggggaaancgccaccctctcctgcgagggccagtcagtagtatagcagtacaacttagccgtaggtaccagacaacgaaacctggaccaggcctacccgaggtccctcctctatcctatcggcctgaccaactccccgaaccgagggggaccctacggttcggttaaccncccgaacggtaccgtacgggttcgagggtcggacgtaggggtcgggtacgtaaggggaactaggtacgtttctacttccaccaacctactacgagaccgacggtcctacgtacgtagtacgtaagtaagttatttagtaactttaaagtttacgttacgttagtacaagtactaagttaattaagtacggtaggtacgtaccggtacgaacgtaaagggtaacgaaaggtaaacgaaacgtaacgaaaacgttacgttggacggtctacgaacctactacttcgttaacgttctaacg

SEQ ID NO: 442174 - DNA, 546 bp, Homo sapiens
  misc_feature: GZ8MTXP01C5ZUY.2.7.A07.1.454.CMB.2.raw
  modified_base (198)..(198): a, c, t, g, unknown or other
  modified_base (262)..(262): a, c, t, g, unknown or other
  modified_base (280)..(280): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagcaacttgcctggtaccagcagaacngccaggctccagctcctnatctatgctgccatcccacgacgggccacgtggtactcccagtcctaggttccagtggactaggtcgggtcgtggggacaggtagttcaattcctacacatcgagcagcctgactagtcagtagtatttgacttaagtttatactgtacagactaagtaataagtacgtggtagtacgtaccggaacgtaaagggacttaaagggtaaagaaactacgaaaacgttacgttggttagaactgaactaccgattcttgttcttaacg

SEQ ID NO: 442175 - DNA, 600 bp, Homo sapiens
  misc_feature: GZ8MTXP01B0D70.2.7.A07.1.454.CMB.2.raw
  modified_base (197)..(197): a, c, t, g, unknown or other
  modified_base (212)..(212): a, c, t, g, unknown or other
  modified_base (260)..(260): a, c, t, g, unknown or other
  modified_base (281)..(281): a, c, t, g, unknown or other
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctccngcagggccagtcagatatagcagcaacttgcctggtaccagcagaacnggccaggctccgaggctcctnatntatcgctgcactcccaaccgacgggccctacgtggtacctcccgagcccgtaggttccaggtcggacgtaggggttggggtaccgtgggggaacctagggtacgtttcactttccactacccatccgaggcacggtccctggacctagtctaggtaagttatttagactttaaattttctaacgttgtacagtactaagttaataacgttaacgtgggtacggtacgttcggaaccgaaaggggtaacttaaagggtaaacgaaagtacgaaacgttagttgttacggctggaacctactattctcgttcttaacc

SEQ ID NO: 442176 - DNA, 577 bp, Homo sapiens
  misc_feature: GZ8MTXP01C0C5Y.2.7.A07.1.454.CMB.2.raw
  modified_base (195)..(195): a, c, t, g, unknown or other
  modified_base (245)..(245): a, c, t, g, unknown or other
  modified_base (253)..(253): a, c, t, g, unknown or other
  modified_base (267)..(267): a, c, t, g, unknown or other
  modified_base (270)..(270): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctccgaaggggaancgccaccctctctgcagggccagtcagatatagcagcaattgcctggacngcagaacngcagctccagctcnatntatgctgcatccgacgtagggcccagtggtactcccgagtccgtaggttcaggtcggcagggttcgggtctggggacagtacgttacagttcctacacctatcgagcagtcctgacgtagtctagtaagttattttacgactttaattttattacttggtactagtactaaagttaataaacgttaacggttggtacgggtaccgttaccgggaacgtaaaggggtaaccgaaagggttaaacaaacgttaccgaaaagttacgttggttacggaactagccaacgtcttactcgttcccttaaccg

SEQ ID NO: 442177 - DNA, 581 bp, Homo sapiens
  misc_feature: GZ8MTXP01BRS0D.2.7.A07.1.454.CMB.2.raw
  modified_base (197)..(197): a, c, t, g, unknown or other
  modified_base (560)..(560): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaacctggccaggcctcccaggctcctcatctatgctgcatcccaccgagggcccacgtggtactccccgagccctaggttcaggtggcagggtggggtatggggactaggtagtttccaatttccacaaccagtcaagcacggccctgaccgaggttctagtaagttatttgacttaatttagttactgtcagtactaagtaataagtacgtggtggtacgttacggaccgtaaagggaaccaaagggttaaacgaaacgttaccgaaaacgttaacgttggttacggcgttagcctaacgnttcttaacggttcctttaacc

SEQ ID NO: 442178 - DNA, 551 bp, Homo sapiens
  misc_feature: GZ8MTXP01ALFQP.2.7.A07.1.454.CMB.2.raw
  modified_base (196)..(196): a, c, t, g, unknown or other
  modified_base (262)..(262): a, c, t, g, unknown or other
  modified_base (373)..(373): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaaccnggaccaggcctcccaggcctcctcatctatgctgcatcccacgagggcccacgtggtactcccagccctaggttcaggtggcaggtgggtctggggacaggtattcattcncaccatcagcagcctgcagtctagaagtnttttgacttaatttagttactgtacagtactagttaataagttaacgtgggtcggtacgttcgggaccgtaaaggggaccaaagggtacgaaacgtacgaaacgttacgttggttcggtaactcgaacacctattcttcgttccttaac

SEQ ID NO: 442179 - DNA, 579 bp, Homo sapiens
  misc_feature: GZ8MTXP01AHXPK.2.7.A07.1.454.CMB.2.raw
  modified_base (197)..(197): a, c, t, g, unknown or other
  modified_base (261)..(261): a, c, t, g, unknown or other
  modified_base (281)..(281): a, c, t, g, unknown or other
  modified_base (411)..(411): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgcagggccagtcagagtatagcagcaattgcctggtaccagcagaaccnggccaggctccagcctcctnatctatgctgcactccccgacgacgggccacgtggtactcccgagcctaggttcaggtgcaggtcgggtctggggactaggtagttcattctacacctatcagcacgtcctgacctagttctagaagttnttttagactttaaatttacttacgtgttacaagtactaagttaataagttaacgtgggttacggtacgttaccggacgtaaacgggtaaccttaaagggtaacgaaacgtacgtaaaacgttacgttggttacggaactgaacctacgattcttaacgttcttaaccg

SEQ ID NO: 442180 - DNA, 648 bp, Homo sapiens
  misc_feature: GZ8MTXP01BPG2V.2.7.A07.1.454.CMB.2.raw
  modified_base (267)..(267): a, c, t, g, unknown or other
  modified_base (311)..(311): a, c, t, g, unknown or other
  modified_base (337)..(337): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaagacgccaccctctcctgcagggccagtcagagtatagcagcaaacttagcctggtaccagacaagaaaccnggccaaggcctacccgaggcctcctcaatctatcgctgacctanccccacgacgggccacgtggtacccnccgagtccgtacggtcgaggtggcgtaggtcgggcgtgggactaggtacttactattcacactatcgacgacacgcctgacgtacgttagtagtaaagttagtttacgtaactttaatttacgttacgttgtaacaacgtacgtaagttaaagttaaacgttaaacgttacggttacgggtaccgggtaccgggtaaccggtaaacgggtaaacggttaaacggtaaacggttaaacgtaaacgtaaacgttaaacgttacggttacggtaacgtacgtaaccgtaacctacttacgttcgttcgttaacg

SEQ ID NO: 442181 - DNA, 526 bp, Homo sapiens
  misc_feature: GZ8MTXP01DZCFO.2.7.A07.1.454.CMB.2.raw
  modified_base (283)..(283): a, c, t, g, unknown or other
  modified_base (473)..(473): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcagaaactgccaggctccaggctcctnatctatgctgcatccacacgggccacgtgtactcccagcctaggttcagtggcaggtcgggtctggggacaggtagttcacgttctcacatcagcagcctgctagtctagagtatttgactaatttattactgtacagatagtataagtaactggtaggtacgtacggacgaaagggtacaaagggtaanaaacgtaacgtaaacgaagttcgttggaactgaacactattactgttcttaac

SEQ ID NO: 442182 - DNA, 554 bp, Homo sapiens
  misc_feature: GZ8MTXP01AG33P.2.7.A07.1.454.CMB.2.raw
  modified_base (197)..(197): a, c, t, g, unknown or other
  modified_base (262)..(262): a, c, t, g, unknown or other
  modified_base (364)..(364): a, c, t, g, unknown or other
  modified_base (395)..(395): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaaccnggccaggctcccaggctcctcatctatgctgcatcccacagggctacgtggtactcccagccaggttcagtggcaggtgggctgggacaggtagttcattcncaccatcagcacgcctgctagtctagaagtnttttgcttaatttattactgttacagtactagtataaagttaacgtgggtgtaccggttcggaccgtaaaggggaaccttaaaggggtaaacgaaactacgaaaacgttacgttcggttacgggaactggccaaccctgttaccgttcgttctttaacc

SEQ ID NO: 442183 - DNA, 640 bp, Homo sapiens
  misc_feature: GZ8MTXP01AU4N9.2.7.A07.1.454.CMB.2.raw
  modified_base (197)..(197): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagcagaaccnggccaggctcccaggcctcctcatctatgctgcatccaccgagggcccacgtggtactcccgagcccgtaaggttcaggtcggctaggtcggggtctggggactagggtacgtttcatttcacacctatcgagcacgccttgacgagtctaggtaagttacgttttagacttaaatttttacgttacgttacgttaccgaaggtaccttaaggttaaacttaaaacggttaacgttgggggttacgggtacccggtttaccggggaaccgtaaacgggggtaacccaaagggggttaaacaaaccgtaaacgtaaaacggttacgttgggttacgggtcgtacgaacctaaccgttcgttaccgttcgttccgttcg

SEQ ID NO: 442184 - DNA, 593 bp, Homo sapiens
  misc_feature: GZ8MTXP01BNINH.2.7.A07.1.454.CMB.2.raw
  modified_base (268)..(268): a, c, t, g, unknown or other
  modified_base (543)..(543): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgcccaccctctcctgcagggccagtcagagtattagcagctaacttagcctggtaccagcaagaaaccnggccaggcctcccgaggcctcctcatctatgctgccatccccaccgtacgggccctacgtcggtactccccgagtcccgtagggttccagggttcggcgtagggtcggggtcctgggggaactaggtacgtttcatttccacaccctatccgagcaggcccttggacctagttctagggtaattacttttgacttaaattttacggttactgtacagtactaagttaataataacggtgggtacgtacgttcggacgaaagggacaaaggtaaanaaagtacgaaagacgttggttggaactgaaccactattcgttcgttcttc

SEQ ID NO: 442185 - DNA, 624 bp, Homo sapiens
  misc_feature: GZ8MTXP01DNJAG.2.7.A07.1.454.CMB.2.raw
  modified_base (197)..(197): a, c, t, g, unknown or other
  modified_base (271)..(271): a, c, t, g, unknown or other
  modified_base (561)..(561): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccgaaggggaaancgcccacctctcctgcaggccagtcagtagtatagcagactaacttacgcctaggtaaccagacaacgaaaccncggaccacggcctcccgaggcctcctacatctatcgctgacctactcccgaaccgacgggaccctacgttcggtaccctccccgaggtcccgtaaggtttccgagggtcggaccgtaggggttcggggttacgtgggggaacctagggttacgtttacaactttccacaacctatcaagcagccctgacgtagttctagtaaagttatttagaactttaaatttcttactgtacagactaagtaataagtacgtggtacgtacgtcgaacgtaaaggacttaaaggtaanaaacgtaaacgaaacgttacgttggacggtcacgaacctaactattccttcgttccttaaccg

SEQ ID NO: 442186 - DNA, 543 bp, Homo sapiens
  misc_feature: GZ8MTXP01ATQE5.2.7.A07.1.454.CMB.2.raw
  modified_base (197)..(197): a, c, t, g, unknown or other
  modified_base (384)..(384): a, c, t, g, unknown or other
  modified_base (412)..(412): a, c, t, g, unknown or other
  modified_base (490)..(490): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcaagaaacctggaccaggcctcccgaggcctcctcatctatcgctgcatcccaccgagggcccacgtggtactcccgagcctaggttcaggtcggctaggtcgggtctggggacaggtagttcatttcncaccatcagcagcctgacagtcagagtntttgacttaatttatactgtacagtctaagtataatacgtggtacggtacgtacggacgaaagggaccaaagggtaanaaacgtaacgtaaacgttacgttgttacggctagaacacattctcgttcttcg

SEQ ID NO: 442187 - DNA, 600 bp, Homo sapiens
  misc_feature: GZ8MTXP01DK2RE.2.7.A07.1.454.CMB.2.raw
  modified_base (199)..(199): a, c, t, g, unknown or other
  modified_base (264)..(264): a, c, t, g, unknown or other
  modified_base (291)..(291): a, c, t, g, unknown or other
  modified_base (415)..(415): a, c, t, g, unknown or other
  modified_base (522)..(522): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaangcccaccctctcctgcagggccagtcagagtatagcagcaacttgcctggtaccagcagaaaccnggccaggctccaggcctcctcatctangctgcatcccacgagggccacgtggtactcccgagcctaggttcagtggctaggtgggtctggggactagggtacgtttcatttcctacaacctatcaggcagcctgactagtctagaaagttntttagacttaaattttattaactgtacagtactaagttaactaaagttaacgtggggtaacgtacggttaccgggaaccgtaaaggggaaccgttaaagggttaaanaaaacgtaacgaaaacgttaacgttcggttacggaaccttgaaccctaacccgtattaccgttcgtttcccttaaccg

SEQ ID NO: 442188 - DNA, 551 bp, Homo sapiens
  misc_feature: GZ8MTXP01A0S9R.2.7.A07.1.454.CMB.2.raw
  modified_base (197)..(197): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttgcctggtaccagcaagaaaccnggccaggctacccgaggcctcctcatctatcgctgcatccccacgagggcccacgtggtactcccagccctaggttcaggtggctaggtgggtctggggacaggtagttcatttcacaccatcagcacgcctgacagtctagaattatttgacttaatttagtactgttacagtctaagttactaagtaacgtgggtcggtacggttcggaacgtaaagggaccttaaaggtagaaactacgaaaacgttacgttgttacggctgaacacctattcttcgttcttcc

SEQ ID NO: 442189 - DNA, 577 bp, Homo sapiens
  misc_feature: GZ8MTXP01EA8T9.2.7.A07.1.454.CMB.2.raw
  modified_base (197)..(197): a, c, t, g, unknown or other
  modified_base (265)..(265): a, c, t, g, unknown or other
  modified_base (288)..(288): a, c, t, g, unknown or other
  modified_base (548)..(548): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttgcctaggtaccagacaagaaaccnggccaggcctcccgaggctcctnatctatgctgcactccacgcgggccacgtcggtactcccgagccgtacggttcaggtggccgtagggtcgggtctgggggactaggtacgttcacgtttccacgacccatcgaacgcacgcctgacctagtctagaagttatttgacttaaattttattacttggtaccaagtctaagttaattaagtaacgtgggtacggtacgttcggaccgaaaggtaccgaaaggtaacgaaatacgaaacgttaacgttggacgntcgaactacctagttccttcgttcttaac

SEQ ID NO: 442190 - DNA, 539 bp, Homo sapiens
  misc_feature: GZ8MTXP01A72L4.2.7.A07.1.454.CMB.2.raw
  modified_base (197)..(197): a, c, t, g, unknown or other
  modified_base (264)..(264): a, c, t, g, unknown or other
  modified_base (418)..(418): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaaaccnggccaggctcccaggctcctcatctatgctgccatcccaccgacgggccctacgtggtactccccgagccctaggttcaggtcggcgtaggtggggtctggggactagggtacgttcattctacacctatcagcagcctgcagtctagaagttntttgacttaatttatactgtcagtctagtataagtacgtgggtagacgttccggacgaaagggtacaaaggtaacaaagtacgaaacgacgttgacggctagcactattcttgttcttaac

SEQ ID NO: 442191 - DNA, 673 bp, Homo sapiens
  misc_feature: GZ8MTXP01ECU0S.2.7.A07.1.454.CMB.2.raw
  modified_base (197)..(197): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttgcctggtaccagcaagaaccnggccaggcctcccgaggcctcctcatctatgctgcactccaccgagggcccacgtggtacctcccgagccgtaggttcaggtggctagggtcgggtcgtgggggactagggtacgtttctacgtttcctacctaaccctattccgaacggtaccgacgtcccgtaggtaccctaggtttactaagggtaaacgttattttggaactttaaatttttaggtttaacgtgttacaacgtagttaagttaacttaaagttaacggttgggttacgggtaccggtttaccgggaaaccggtaaaacgggtaacccgttaaaagggtaaacgttaaaacgtaaccgtaaaaacggttacggtttggttacggtcctagaacccgtaacctagttccttaacggtttcctttaaccg

SEQ ID NO: 442192 - DNA, 550 bp, Homo sapiens
  misc_feature: GZ8MTXP01C34DZ.2.7.A07.1.454.CMB.2.raw
  modified_base (196)..(196): a, c, t, g, unknown or other
  modified_base (411)..(411): a, c, t, g, unknown or other
  modified_base (542)..(542): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttagcctggtaccagcaagaaacctggaccaggcctcccaggcctcctcatctatgctgcactcccacgacgggccacgtggtactcccagccctaggttcaggtggctaggtcggggtctgggggacagtagttcattctcaccatcagcaggcctggctagtctagaagtnttttagacttaattttattaacttgtactagtactaagttaattaagtaacgttggggtacggtacgttcggacgaaagggacgaaagggtaacaaagtaccgaaagacgttggaggctagcacattcgtnttcttaac

SEQ ID NO: 442193 - DNA, 553 bp, Homo sapiens
  misc_feature: GZ8MTXP01C1TLD.2.7.A07.1.454.CMB.2.raw
  modified_base (198)..(198): a, c, t, g, unknown or other
  modified_base (264)..(264): a, c, t, g, unknown or other
  modified_base (537)..(537): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangcccaccctctcctgcagggccagtcagagtattagcagcaacttgcctggtaccagcagaaaccnggccaggctcccaggcctcctcatctatcgctgcactccaccgagggcccacgtggtacctcccgagcctaggttcaggtggcaggtgggtctggggactaggtagttcagttcacacatcagcagccttgctagtctagtaagttatttgaacttaattttacttacgtgttacagtactaagttaataagttacgtggtacggtacgttacggacgaaagggacttaaaggtaacgaaagtaacgaagaacgttgttaggctagcaccgtnttacgtgttcttaacc

SEQ ID NO: 442194 - DNA, 740 bp, Homo sapiens
  misc_feature: GZ8MTXP01C7Y0F.2.7.A07.1.454.CMB.2.raw
  modified_base (196)..(196): a, c, t, g, unknown or other
  modified_base (262)..(262): a, c, t, g, unknown or other
  modified_base (284)..(284): a, c, t, g, unknown or other
  modified_base (713)..(713): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttgcctggtaccagcaagaaccnggccaggctcccgagcctcctnatctatgctgcactcccaccgagggcccacgttggtacctccccgagtccccgtaggtttccgagggtggacgtagggttcggggtagtcgggggaactagggtacggtttcaacgtttcctaccaacctattaccgaacggccgaacgtcccgttaggaccttaacggttcgttaaggtaaacgttaagttttttacgaaaccttttaaattttttaacggtttaacccgttacgggtttacctaaagggtaaccttaaaaggtttaaactttaaacgtttaaaccggggtttggggttaaccgggggttaaacccggtttacccggggaaaccgggtaaaaacgggggtaaccgttaaaagggggttaaacaaaacgttaaaccgaaaaaccggttagttcgggttacggcttaacgccgttaaccnggtttacccttgttaacctttaacccg

SEQ ID NO: 442195 - DNA, 557 bp, Homo sapiens
  misc_feature: GZ8MTXP01AZ1BD.2.7.A07.1.454.CMB.2.raw
  modified_base (196)..(196): a, c, t, g, unknown or other
  modified_base (277)..(277): a, c, t, g, unknown or other
  modified_base (505)..(505): a, c, t, g, unknown or other
tcagacgctcgacacacgaccggtgctcgatttagcacgtgtcgcgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttgcctggaccagcagaacctggccaggctccagctcctnatctatgctgcatcccacgagggccctagtggtactccccgagccctaggttcccaggtggctaggtcggggtactaggggaactaggtagtttcatttccacacatcagcagcctgctagtctagaagttatttagacttaaagttttattacgtgtacagtactaagttaataagttaacgtgggtacgtacggttcggaccgtaaagggaacctaaagggttaanaaacttacgaaacgtacttggttggctgactaacctattcgttactcttctc

SEQ ID NO: 442196 - DNA, 536 bp, Homo sapiens
  misc_feature: GZ8MTXP01AQ37C.2.7.A07.1.454.CMB.2.raw
  modified_base (197)..(197): a, c, t, g, unknown or other
  modified_base (264)..(264): a, c, t, g, unknown or other
  modified_base (284)..(284): a, c, t, g, unknown or other
  modified_base (406)..(406): a, c, t, g, unknown or other
  modified_base (428)..(428): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagcagaaaccnggccaggctccaggctcctnatctatgctgcactccaccgagggcccacgtggtactcccagcctagggttccaggtggcaggtgggtctggggacaggtacgttcatttcacaccatcagcagcctgcagtctagaagttntttgacttaatttattactgtnagtactaagtaactaatacgtggtacggacgttcggacgtaagggaccaaagggtaagaaacgtacgaaacgacgttggttacgctgaacacattctcgttcttaacc

SEQ ID NO: 442197 - DNA, 554 bp, Homo sapiens
  misc_feature: GZ8MTXP01EYJW8.2.7.A07.1.454.CMB.2.raw
  modified_base (198)..(198): a, c, t, g, unknown or other
  modified_base (299)..(299): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccacccctctcctgcagggccagtcagagtattagcagcaacttagcctggtaccagcaagaaacctggaccaggcctcccaggcctcctcatctatnctgcatccacgacgggccactggtactcccagccaggttccagtggctaggtgggtcgtggggacaggtacgttcagttcctcaccatcagcagcctgacagtctagaagtatttgacttaatttattacttgtcagactaagtaactaagtaacgtggtacggtacggttcggacgtaaaggggaaccttaaagggtaattaaactacgaaaacgttaacgttggttacggctagcctacagttctgttctaac

SEQ ID NO: 442198 - DNA, 531 bp, Homo sapiens
  misc_feature: GZ8MTXP01A30LY.2.7.A07.1.454.CMB.2.raw
  modified_base (197)..(197): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaaccnggccaggctcccaggctcctcatctatgctgcatcccaccagggcccactggtactcccagccaggttcagtggcaggtgggtctgggacagagttcattctcaccatcagcagcctgcagtctagaagtattttgacttaatttagttactgttacagtctaagtataataacttgggtggtacgttcggaccaaaggggaaccaaagggtaacgaaatacgaaaacgttacgttggttaggctggcacctattcctgttcttaac

SEQ ID NO: 442199 - DNA, 552 bp, Homo sapiens
  misc_feature: GZ8MTXP01AZY4G.2.7.A07.1.454.CMB.2.raw
  modified_base (264)..(264): a, c, t, g, unknown or other
  modified_base (376)..(376): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgccaccctctcctgcagggccagtcagagtatagcagcaacttagcctggtaccagcaagaaaccnggccaggcctcccaggctcctcatctatgctgcatcccgaccgagggccagtggtactcccagccaggttcaggtcggctaggtggggtctggggactaggtagttcattcncaccatcagcagcctgactagtctagaagtatttgacttaatttagttactgtcagtctaagttataagtacgttgggtaggtacgttcgggaccaaaggggtaccaaagggtacaaagtaccgtaaacgttaacgttggttacggaactggaacctactattccgtcgttcgttc

SEQ ID NO: 442200 - DNA, 715 bp, Homo sapiens
  misc_feature: GZ8MTXP01BLDCX.2.7.A07.1.454.CMB.2.raw
  modified_base (196)..(196): a, c, t, g, unknown or other
  modified_base (264)..(264): a, c, t, g, unknown or other
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaancgccaccctctcctgcagggccagtcagagtattagcagcaacttagcctggtaccagcaagaaaccnggccaggcctcccaggcctcctnatctatgctgcactcccaccgagggccctacgtcggtactccccgagtcccgtaacggttcaggtcggaccgtagggttcggggtctgggggactaagggtacgtttcacgtttccgactaaccctattaccgaagtccgaacggtccccttaggtacccgtaacggtttccgttaagggtaaaggtttacttttttacggaaaccttttaaagttttttaacgtttaaccgtttagggttaccctaaagggtacccttaaaagggtttaaacttaaacggtttaaacccggttgggggttaccgggtaaaccgggttttcccgggaaaccggtaaacggggtaacccttaaaggggtaacaaaacgttacgaaaacggttaacgttggttacggctcgaacctacctagttctaagttccttaaccg

SEQ ID NO: 442201 - DNA, 530 bp, Homo sapiens
  misc_feature: GZ8MTXP01BRPX6.2.7.A07.1.454.CMB.2.raw
  modified_base (196)..(196): a, c, t, g, unknown or other
  modified_base (261)..(261): a, c, t, g, unknown or other
  modified_base (280)..(280): a, c, t, g, unknown or other
  modified_base (393)..(393): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacnggccaggctccagctcctnatctatgctgcatccacagggccatgactcccagccagttcagtgcaggtgggtctggggacagtacgtttcatttcacaccctatcagcagcctggactagtctagaagttnttttgacttaattttagttactgttacagactaagtattaaagtacgtggttacggacgtttcgaccgaaagggtccaaagggtacaaagtacaaaacggttattggttaggctagctaccgattcgtcgttctttc

SEQ ID NO: 442202 - DNA, 554 bp, Homo sapiens
  misc_feature: GZ8MTXP01D744S.2.7.A07.1.454.CMB.2.raw
  modified_base (196)..(196): a, c, t, g, unknown or other
  modified_base (262)..(262): a, c, t, g, unknown or other
  modified_base (403)..(403): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaangtcaccctctcctgcagggccagtcagagtattagcagcaacttagcctggtaccagcaagaaccnggccaggcctcccgaggcctcctcatctatgctgcactccaccgagggccacgtggtactcccagccaggttcagtggcaggtgggtctggggacaggtagttcattctcaccatcagcagcctgactagtctagaagttntttgacttaatttattactgtactagtactaagttaataagtaaacgtgggtacggtacggttacggacgaaagggtaccaaagggtaacaaagtacgaaaacgttacgttggttacggaactagaactaacctattctcgttcttaaccg

SEQ ID NO: 442203 - DNA, 580 bp, Homo sapiens
  misc_feature: GZ8MTXP01ALOKT.2.7.A07.1.454.CMB.2.raw
  modified_base (197)..(197): a, c, t, g, unknown or other
  modified_base (262)..(262): a, c, t, g, unknown or other
  modified_base (381)..(381): a, c, t, g, unknown or other
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcagaaccnggccaggctccaggctcctcatctatgctgcactcccgaccgagggccctagtggtactccccgagccctaggttccaggtcggctaggtgggtctggggactagggtagttcatttcncaccctatcagcacgcctagcagtctagtaagttntttgacttaatttcgtactgtcagtactagtactaagtacgtgggtcggtaccgttacggaccgtaaaggggtaccaaagggtaagaaacgttaccggaaaacgacgttgggttacggtaacctacggaacctacccgtattcccgtaagttcccgttaacccg

SEQ ID NO: 442204 - DNA, 778 bp, Homo sapiens
  misc_feature: GZ8MTXP01CYN3R.2.7.A07.1.454.CMB.2.raw
  modified_base (197)..(197): a, c, t, g, unknown or other
  modified_base (262)..(262): a, c, t, g, unknown or other
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaangccaccctctcctgcagggccagtcagagtatagcagcaacttgcctggtaccagcaagaaaccnggccaggctccgaggcctcctnatctatcgctgccactcccaccgacgggcccacgtggtactcccgagcccgtaggttccaggtggctaggtcgggtctggggactaggtacgtttcacgtttcctacaaccctagttccaaacggtcccgaacggtcccccgttagggacccgttaacgggtttacccgttaacggggttaaaacgtttagtttttttacgggaaacctttttaaaaagtttttttaccgttttaaaccggtttacgggtttaacccaaagggttaacccctttaaaaagggtttaaacttttaaaacggtttaaaacccggttgggggttaaccggggttaacccgggttttaaccgggggaaaccccggtaaaaacggggggtaaaccccttaaaagggggttaaacgaaaacgttaaacccgaaaacgggttaaccgttggggttacgggaaccttacgggaaccctaaccgtacgttaccgttcgttaacctttaacccg

SEQ ID NO: 442205 - DNA, 551 bp, Homo sapiens
  misc_feature: GZ8MTXP01ED972.2.7.A07.1.454.CMB.2.raw
  modified_base (196)..(196): a, c, t, g, unknown or other
  modified_base (420)..(420): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtattagcagctaacttagcctggtaccagcaagaacctggccaggctcccaggcctcctcatctatcgctgcactcccacgacgggccacgtggtactcccagcctaggttcaggtggctaggttcgggtctggggactagggtacgttcatttcacacctatcaggcagcctgctagtctagaagttagtttnacttaattttacttactgtacagctaagtataagtaacgtggtaggaccgttcgaccgtaaagggtaccaaaggtaagaaatacgaaacgttaacgttggttaggctagctaccattctaacgttcttaac

SEQ ID NO: 442206 - DNA, 557 bp, Homo sapiens
  misc_feature: GZ8MTXP01C7ROX.2.7.A07.1.454.CMB.2.raw
  modified_base (196)..(196): a, c, t, g, unknown or other
  modified_base (260)..(260): a, c, t, g, unknown or other
  modified_base (276)..(276): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttgcctggtaccagcagaacnggcagctccagctccnatctatgctgcatcccaccgagggccacgtggtactcccgagcccgtaggttccaggtcggactagggtcgggtctgggggactaggtacgttcattcctcacctatcgagcagccctgactaggtctaggaagttatttgacttaatttattactgtacagtactaagttaataattaacgtgggttacggtacgttcgggaaccgaaaggggaaccaaagggttaacgaaagttaaccgaaacgttaacgttgacggtctagctactattctgttcttc

SEQ ID NO: 442207 - DNA, 539 bp, Homo sapiens
  misc_feature: GZ8MTXP01A6EVE.2.7.A07.1.454.CMB.2.raw
  modified_base (196)..(196): a, c, t, g, unknown or other
  modified_base (261)..(261): a, c, t, g, unknown or other
  modified_base (269)..(269): a, c, t, g, unknown or other
  modified_base (281)..(281): a, c, t, g, unknown or other
  modified_base (369)..(369): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaccnggccagcncccaggctcctnatctatgctgcatcccaccgagggcccactggtactccccgagccaggttcaggtggctaggtggggtctgggacagtagttcattcncacatcagcagcctgcagtctagagtatttgacttaatttattacgtgtcagtctagtataaattaaacgtggtaggtacgttcggcctaaaggggacccttaaagggtaagaaactcgaaaacggttacgttgttacggctggccaacctattccgttgttccttaacg

SEQ ID NO: 442208 - DNA, 761 bp, Homo sapiens
  misc_feature: GZ8MTXP01DLQ07.2.7.A07.1.454.CMB.2.raw
  modified_base (196)..(196): a, c, t, g, unknown or other
  modified_base (260)..(260): a, c, t, g, unknown or other
  modified_base (279)..(279): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccacctctctgcagggccagtcagagtattagcagcaacttgcctggtaccagcaagaaccnggccaggctccaggctccnatctatgctgcactcccgaccgacgggcccacgtggtactcccgagtccctaggttccaggtcggcgtagggtcggggtcgtgggggactaagggtacgtttacctaactttccgtaccaaacccgtacgttacaaacggtcccgaacggttccccgttagggtaacctaaggtttaccgttaaagggttaaaacgtttaagttttttacggaaaccttttaaaaagttttttacggtttaaaccctttaggttaaacccgtaaggttaaccttaaaaggtttaaatttaaaaacggtttaaaccggtttgggggttaaccggggttaaaccggtttacccgggggaaacccgtaaaagggggtaaacccgttaaaagggggtaaacttaaaaacgttaaccgggaaaaacgttaaacccggttgggttaccgggtaactacggtaacccaaccgtattcccgttaacgttcctttaacccg

SEQ ID NO: 442209 - DNA, 542 bp, Homo sapiens
  misc_feature: GZ8MTXP01EISUP.2.7.A07.1.454.CMB.2.raw
  modified_base (196)..(196): a, c, t, g, unknown or other
  modified_base (348)..(348): a, c, t, g, unknown or other
  modified_base (360)..(360): a, c, t, g, unknown or other
  modified_base (371)..(371): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccacctctcctgcagggccagtcagagtattagcagcaacttagcctggtaccagcagaaacctggccaggctcccaggctcctcatctatgctgcatcccaccagggcccagtgtactccagccaggttcagtggcaggtggtctggganagagttcattcncacatcagcancctgcagtctgaagtattttgacttaatttattactgtacagtctaagttataaattaacgttggtacggtacggtttccgggacccgaaaggggacccaaaggggttaaacaaacttacgaaaacgttaacgttggttacgaactgaacacctattactgttctttaacg

SEQ ID NO: 442210 - DNA, 626 bp, Homo sapiens
  misc_feature: GZ8MTXP01DYWYR.2.7.A07.1.454.CMB.2.raw
  modified_base (198)..(198): a, c, t, g, unknown or other
  modified_base (265)..(265): a, c, t, g, unknown or other
  modified_base (608)..(608): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgcccaccctctcctgcagggccagtcagagtatagcagcaacttgcctggtaccagcaagaaccnggaccaggcctaccaggcctcctcatctatgctcgacactcccaccgagggccacgtgtactccagcctaggttcaggtggcgtaggtcgggtctggggaactagggtaacgtttcactttccgtactaaccattacgaggtccacggtccttaggacccgtaagttccgtaaggtaaagtttatttttcgaactttaaatttttaacggttaccgttaggtaccaaggtactaaaggttaacttaaagttaacggttgggtacggtaccggttacgggaaccgtaaaggggaccaaaggtacgaaatacgaaacgttacgttggacggtctggaactaccgnttaccgttgttcctaacg

SEQ ID NO: 442211 - DNA, 569 bp, Homo sapiens
  misc_feature: GZ8MTXP01AHY0K.2.7.A07.1.454.CMB.2.raw
  modified_base (197)..(197): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtatagcagcaacttgcctaggtaccagcagaaccnggccaggctccaggctcctcatctatgctgcatcccacgagggcccacgtcggtactcccgagccgaggttcaggtggctagggtcgggtctggggactaggtagtttcatttcacaccctatcagcacgcctggaccagttctaggtaacgttattttcgactttaaattttacgttactgttacaagtactaagttaataagtaacgtgggtcgtacgttcggacgaaagggaacaaaggtacgaaacgtacgaaaacgacgttggttacggctacggaacctacctagttcctgttccttaac

SEQ ID NO: 442212 - DNA, 536 bp, Homo sapiens
  misc_feature: GZ8MTXP01BGNZK.2.7.A07.1.454.CMB.2.raw
  modified_base (196)..(196): a, c, t, g, unknown or other
  modified_base (286)..(286): a, c, t, g, unknown or other
  modified_base (494)..(494): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcaagaaacctggccaggctcccaggcctcctnatctatgctgcatcccacagggccacgtggtactcccagcctaggttcaggtggctaggtgggtctggggacaggtagttcagttctacaccatcagcagcctgacagtcgtagtaatatttagacttaatttagttactgtacagtactaagtaataagttaacgtggttacggacgtttcggaccgtaaagggaccaaagggtaanaaagtacaaagacgttgttggaactgcacattctgttcttcg

SEQ ID NO: 442213 - DNA, 535 bp, Homo sapiens
  misc_feature: GZ8MTXP01A5PSJ.2.7.A07.1.454.CMB.2.raw
  modified_base (263)..(263): a, c, t, g, unknown or other
  modified_base (396)..(396): a, c, t, g, unknown or other
  modified_base (477)..(477): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaaccnggcaggctcccaggctcctcatctatgctgcatcccacagggccactggtatcccagccaggttcagtggcaggtgggtctgggacagtagtttccatttcacacccatcaggcagcctgcagtctagaagtntttgacttaatttagttaactgtctagactagtataaagtactaggtggtacgttcggactaacggggacaaacgggtaanaaacgtaacgaacgttaacgttggttagtcgtacgcctactacgttcttcgttccgtc

SEQ ID NO: 442214 - DNA, 566 bp, Homo sapiens
  misc_feature: GZ8MTXP01C4X0Z.2.7.A07.1.454.CMB.2.raw
  modified_base (197)..(197): a, c, t, g, unknown or other
  modified_base (263)..(263): a, c, t, g, unknown or other
  modified_base (282)..(282): a, c, t, g, unknown or other
  modified_base (417)..(417): a, c, t, g, unknown or other
  modified_base (561)..(561): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaaccnggccaggctccagcctccnatctatgctgcactcccacgagggcccacgtggtactcccgagccgtaaggttccaggtggactaggttcggggtctggggacagggtacgtttcattcacaccatcagcacgtcctaagagttctagtaagttntttagacttaaatttacttacgtgttacaagtactaagtaactaagttaacgtgggtagtaccggttcggaaccgtaaagggtaacctaaagggttataaacacgaaaacgtagttggttggctaagacaacatcttcgtcttntaacc

SEQ ID NO: 442215 - DNA, 583 bp, Homo sapiens
  misc_feature: GZ8MTXP01AS6YG.2.7.A07.1.454.CMB.2.raw
  modified_base (197)..(197): a, c, t, g, unknown or other
  modified_base (264)..(264): a, c, t, g, unknown or other
  modified_base (393)..(393): a, c, t, g, unknown or other
  modified_base (534)..(534): a, c, t, g, unknown or other
  modified_base (571)..(571): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttgcctggtaccagcaagaaaccnggccaggcctcccgaggcctcctcatctatcgctgccactcccaccgacgggcccacgtggtactcccgagtccagggttcaggttcggctagggtcggggtactggggactaggtagtttcagtttcncaacctatcaggcacgcctgactagtctagtaaagttcgttttagactttaaattttacttaacgttgtacgagtactaagttacttaaagttacgtgggtacggtaccgttacggaccgtaaagggaacttaagggtaanaaacgtaacgaaagttacgttggaggctagcacgtancttcgttctccg

SEQ ID NO: 442216 - DNA, 602 bp, Homo sapiens
  misc_feature: GZ8MTXP01AH4F7.2.7.A07.1.454.CMB.2.raw
  modified_base (198)..(198): a, c, t, g, unknown or other
  modified_base (263)..(263): a, c, t, g, unknown or other
  modified_base (287)..(287): a, c, t, g, unknown or other
  modified_base (330)..(330): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgcccaccctctcctgcagggccagtcagagtatagcagcaattgcctggtaccagcagaaaccnggaccaggcctccgaggcctcctnatcctatcgctgaccatcccaccgagggccctacgtcggtacncccgagtccgtagggttcaggtcgggcctaggttcggggtcgtaaggggacaggtacgtttcacgttctacacgatcacgcgacgtcctagactagtctagtaagttattttagactttaaagtttacgttactagtaccaagtacttaagttaataacgttaacggtgggttacggtaccggttacggaccggaaagggtaccgaaagggtaacaaacgtacgaaacgttcgttgcggtaactagaacctacgtacttgtcgttcttaacg

SEQ ID NO: 442217 - DNA, 645 bp, Homo sapiens
  misc_feature: GZ8MTXP01CQJ46.2.7.A07.1.454.CMB.2.raw
  modified_base (196)..(196): a, c, t, g, unknown or other
  modified_base (298)..(298): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctccagatgccatggagaagtggtgatgacgcagtctccagccaccctgtctgtgtctccgaaggggaancgccacctctcctgcgagggccagtcagagtatagcagactaacttagcctaggtacccagacaacgaaacctggaccaggcctacccgaggtcctccctanacttcctatcgctcgaccaactcccgaaccgacgggccctaacgttcggtaacctccccgagtcccgtaaggttcaaggtggaccgtagggttcggggtactgggggaactagggtacgtttcattccgtacaccattcacgctacgccttagacctagtactagtaagttctttagacttaaattttagtacttggtacagtactaagtaactaagtacgtggtcggtacgttcggaacggtaaagggaaccgttaaaggtaacgaaacgtaaacgtaacgttaacgttcggacgggtaacttacggaacctaacccgtttcgttacgttaacgttccgttaaccg

SEQ ID NO: 442218 - DNA, 584 bp, Homo sapiens
  misc_feature: GZ8MTXP01BGT1D.2.7.A07.1.454.CMB.2.raw
  modified_base (267)..(267): a, c, t, g, unknown or other
  modified_base (286)..(286): a, c, t, g, unknown or other
  modified_base (320)..(320): a, c, t, g, unknown or other
  modified_base (554)..(554): a, c, t, g, unknown or other
  modified_base (567)..(567): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgccaccctctcctgcagggccagtcaagagtattagcagcaacttagcctggtaccagcaagaaccnggcaggctccaggctcctnatctatgctgcatcccacagggccacgtggtacncccagcctaggttcaggtggcgaggtcgggtactggggacaggtacgtttcaatttccacaaccctattacgaaggcaacgtccctaggactaaggttctagggtaaattattttagacttaaattttagttactgttacacgtataagttaataaattacgtgggtacggtacgtcggaaccgtaaaggggacttaaagggtaagaaatacgaaaagttacgttggttacggntcggaacaacctnttacgtcgttccttaac

SEQ ID NO: 442219 - DNA, 560 bp, Homo sapiens
  misc_feature: GZ8MTXP01BKIEW.2.7.A07.1.454.CMB.2.raw
  modified_base (197)..(197): a, c, t, g, unknown or other
  modified_base (260)..(260): a, c, t, g, unknown or other
  modified_base (279)..(279): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaacnggcaggctccaggctcctnatctatgctgcactcccaccgagggccctacgtggtactcccagcctaggttcagtggcaggtgggtctggggacaggtagttcatttcacacctatcagcaggcctgacagtctagaagttntttgacttaatttattactgtacagtactaagttaataagttaacgtggtacggtacgttcgggacgtaaagggtaccttaaagggtaacgaaagtaacgaaaacgttacgttggttacggaaccttggaacctacctattccgttcgttcctttaac

SEQ ID NO: 442220 - DNA, 564 bp, Homo sapiens
  misc_feature: GZ8MTXP01C2Z3T.2.7.A07.1.454.CMB.2.raw
  modified_base (199)..(199): a, c, t, g, unknown or other
  modified_base (267)..(267): a, c, t, g, unknown or other
  modified_base (383)..(383): a, c, t, g, unknown or other
  modified_base (425)..(425): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaanacgcccaccctctcctgcagggccagtcagagtatagcagcaacttgcctggtaccagcaagaaaccnggccaggctcccaggctcctcatctatgctgcactcccaccgagggcccacgtcggtactcccgagccgtacggttcaggtggcgaggtcgggtctggggacaggtagttcattcncaccatcagcagcctgcagtctagagtatttgacttaatttntactgtcagactaagtaataataacgtggtacggtacgtcggaacgtaaagggtaccttaaagggtaaacaaagttaaaccgaaaaggttaacgttggttacggtaactacgtccaacgtattcgttcgttcttaaccg

SEQ ID NO: 442221 - DNA, 572 bp, Homo sapiens
  misc_feature: GZ8MTXP01BIDFX.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagacgccactggagaagtggtgatgacgcagtctccagccaccctgtctgtgtctccgaggggaaangcccaccctctcctgcagggccagtcagagtattagcagcaacttagcctggtaccagcagaaacctgccaggctcccgagcctcctcatctatgctgcatcccacgaggcccagtggtactcccagtccaggttcccaggtggcaggtgggtctggggaacaggtagttcatttccacaacctatcagcagcctgctagtctagtaagttatttagacttaaattttacgttacgttgtacgtagtactaagttaataaattaacgtgggtacggtacgttacggacgtaaagggaacgaaaggttaagaaacgttacgaaaacgtacgttaggttcggactaagacctaactacgtcttcgttcttcgtaacc

SEQ ID NO: 442222 - DNA, 647 bp, Homo sapiens
  misc_feature: GZ8MTXP01EK4SV.2.7.A07.1.454.CMB.2.raw
  modified_base (197)..(197): a, c, t, g, unknown or other
  modified_base (264)..(264): a, c, t, g, unknown or other
  modified_base (359)..(359): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcaagaaaccnggccaggctcccaggctcctcatctatgctgccactccacggcgacctacgtcgtaccaccgacgcgtacgtcgaggtcgacgtgggtcggtggnggactaggtacttctacttctaccaactacgtacgacgacgaccgtcgtacgacgttacgttacgtaaggtaatttacgtttacgtaacttttaaattttacgttaacgttcgtacgtacggtaacttaaagttaaatttaaccggttaaacggttggggtaaccggttaccggttaaccggaacgggaaacggtaaacgttaaagggtaaacttaaacgtaaaccgaaacgttagtttcggacgtaaccgtacaaccgtaacctcgttcgtttcgttccgtttaacg

SEQ ID NO: 442223 - DNA, 560 bp, Homo sapiens
  misc_feature: GZ8MTXP01AWXAY.2.7.A07.1.454.CMB.2.raw
  modified_base (197)..(197): a, c, t, g, unknown or other
  modified_base (207)..(207): a, c, t, g, unknown or other
  modified_base (262)..(262): a, c, t, g, unknown or other
  modified_base (281)..(281): a, c, t, g, unknown or other
  modified_base (366)..(366): a, c, t, g, unknown or other
  modified_base (396)..(396): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangcccaccctntcctgcagggccagtcagagtattagcagcaacttgcctggtaccagcagaaccnggcaggctcccaggctctnatctatgctgcactcccacgagggccacgtggtactcccagccaggttccaggtggcaggtgggtctggggacagagttcattcncaccatcagcagcctgcagtctagaagttntttgattaatttagtacgtgtacagtactaagttaattaaagttacgtgggttacggtaccggttaccgggaaccggaaacgggtaacttaaagggtaaacaaacgtaacgtaaacgttacgttggttacggtctcgaacctaactcgttcttcgttcctaacg

SEQ ID NO: 442224 - DNA, 608 bp, Homo sapiens
  misc_feature: GZ8MTXP01CVM28.2.7.A07.1.454.CMB.2.raw
  modified_base (196)..(196): a, c, t, g, unknown or other
  modified_base (256)..(256): a, c, t, g, unknown or other
  modified_base (274)..(274): a, c, t, g, unknown or other
  modified_base (582)..(582): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctccagatgccactggagaagtggtgatgacgcagtctccagccacctgtctgtgtctccgaggggaaancgccaccctctctgcagggccagtcagagtatagcagcaattgctggaccagcagaaccnggcaggctccagctcctnatctatgctgcactcccacgagggcccagtcggtactccccagcctaaggttcaggtggctaggtgggtctggggacaggtacgttcattcctacaccatcagctacgtccttacgacgttcgtagtaagttatttagtaactttaaattttacttacgttacgtacgtagtacgtaaagttaaattaaacgttaacgttaggggttacggtaaccggttacgggaaccggtaaaggggtaaacctaaaggggttaataaaacgttaccgtaaaaacggtacgttaggttcggacttgacctaacgtntcgttacgttccttaacgttaacccg

SEQ ID NO: 442225 - DNA, 552 bp, Homo sapiens
  misc_feature: GZ8MTXP01APRF7.2.7.A07.1.454.CMB.2.raw
  modified_base (197)..(197): a, c, t, g, unknown or other
  modified_base (259)..(259): a, c, t, g, unknown or other
  modified_base (278)..(278): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccacctctctgcagggccagtcagagtatagcagcaacttgcctggtaccagcagaaccnggcaggctccaggctcctnatctatgctgccatcccaccgagggccacgtgtactcccgagcctaggttcaggtggcgtaggtcgggtctggggactagggtacgttcacgttccacacccgatcgaagcagcctagacctagttctagtaagttatttgaacttaattttattacgtgtacagtactaagtaataagttacggtggtagtacgtcgacgaaagggacttaaagggtacaaagtacgaaacgttacgttgttacggctagaaccacgtcttctcgttcttccg

SEQ ID NO: 442226 - DNA, 546 bp, Homo sapiens
  misc_feature: GZ8MTXP01AYBDG.2.7.A07.1.454.CMB.2.raw
  modified_base (197)..(197): a, c, t, g, unknown or other
  modified_base (263)..(263): a, c, t, g, unknown or other
  modified_base (316)..(316): a, c, t, g, unknown or other
  modified_base (364)..(364): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaaccnggccaggctccaggctcctcatctatgctgcatccacagggccacgtggtacncccagccaggttcagtggcaggtgggtctgggacaggtagttcattcncacctatcagcagtctgacagtctaggaattactttgacttaatttatactgtacagtactagtaataagtacgtgggtagtaccgttcgggactaaagggaaccgttaaagggtacaaacgtacgaaaacgttacgttggttcgggtaactacgaacaccgtacttcttcgttcctaaccg

SEQ ID NO: 442227 - DNA, 615 bp, Homo sapiens
  misc_feature: GZ8MTXP01BGJGO.2.7.A07.1.454.CMB.2.raw
  modified_base (199)..(199): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaaggggaaancgccaccctctcctgcgagggccagtcagagtatagcagcaacttagcctggtaccagcagaaaccnggccaggcctccaggcctcctcatctatgctgcactcccacgagggcccacgtggtactcccgagcctaggttccaggtcggacgtacgggtggggtacctgggggaactaggtacgttcaacgtttccactacccatcagcacgtccctgacctagttctaggtaagttattttacgactttaaattttacttacttggtaccaagtctaaagttaataagtaacggttggtacgggtacgttccgggaaccgtaaaggggtaaccttaaaggggtaaacaaacgttaaacgaaacgttaagttcgttacgggctacggaacaccgtagttcgttcgttccttaaccg

SEQ ID NO: 442228 - DNA, 533 bp, Homo sapiens
  misc_feature: GZ8MTXP01D4B9S.2.7.A07.1.454.CMB.2.raw
  modified_base (197)..(197): a, c, t, g, unknown or other
  modified_base (262)..(262): a, c, t, g, unknown or other
  modified_base (377)..(377): a, c, t, g, unknown or other
  modified_base (408)..(408): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccacctctctgcagggccagtcagagtattagcagcaacttagcctggtaccagcagaaaccnggccaggctcccaggcctcctcatctatgctgcatcccacgagggccacgtggtactcccagccaggttcaggtggctaggtcggggtctgggggactaggtagtttcagtttcncaacctatcagcagcctgcagtctagaagtntttagacttaattttattacttgtctagactagtaattaataacgtggtagtacgttcggacgaagggacaaagggtacaaagtacgtaacgacgttggttagcgtgctacattctgttcttaac

SEQ ID NO: 442229 - DNA, 579 bp, Homo sapiens
  misc_feature: GZ8MTXP01CDXW8.2.7.A07.1.454.CMB.2.raw
  modified_base (285)..(285): a, c, t, g, unknown or other
  modified_base (463)..(463): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctnatctatcgctgcatccacagggccacgtgactcccagcctaggttcaggtgctaggtcggggctggggactaggtacgttcactttctccacctatcgaggcagccttgacctagtctaggtaagttatttcgacttaaattttatacgtgttaccagtactagtaataagttaacgngggttacggacggttcggaccgtaaagggaccttaaagggtaaacgaaacgtaacgtaaacgttaacgttggttacggtctacggaacctaccggtattccttaagttccttaacc

SEQ ID NO: 442230 - DNA, 522 bp, Homo sapiens
  misc_feature: GZ8MTXP01CYLBC.2.7.A07.1.454.CMB.2.raw
  modified_base (197)..(197): a, c, t, g, unknown or other
  modified_base (264)..(264): a, c, t, g, unknown or other
  modified_base (285)..(285): a, c, t, g, unknown or other
  modified_base (403)..(403): a, c, t, g, unknown or other
  modified_base (483)..(483): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaaccnggccaggctcccaggctcctnatctatgctgcatcccaccgagggccactggtactcccagcctaggttcagtggcaggtcgggtctggggacaggacgtttcatttctcaccatcagcagtcctgcagtctagagttntttgacttaatttagttactgttacagtctagtattaacgtaacgtgggtacggacgttcggacgtaagggacaaggtanaaatacgaaagacgttgttggctgcaccattctgttctc

SEQ ID NO: 442231 - DNA, 592 bp, Homo sapiens
  misc_feature: GZ8MTXP01BPIL7.2.7.A07.1.454.CMB.2.raw
  modified_base (197)..(197): a, c, t, g, unknown or other
  modified_base (467)..(467): a, c, t, g, unknown or other
  modified_base (558)..(558): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtacccagacaacgaaacctgtaccaggcctacccgaggcctcctcatctatcgctgcactcccacgacgggccctagtcggtaactccccgagtcccgtaggttccaggtcggccgtagggtcgggtacgtggggactaggtacgttcagtttcacgaccatcagcacgtcctgacctagttctaggaagttatttgacttaaattttatacgtggtanacgtataagtaatagttaacggtggtacggtaccgttcggaaccgaaaggggaccttaaaggtacgaaacgtaccgaaacgttagttgggnggtctagaacctacgtattcgtcgttcttaaccg

SEQ ID NO: 442232 - DNA, 702 bp, Homo sapiens
  misc_feature: GZ8MTXP01DI0S3.2.7.A07.1.454.CMB.2.raw
  modified_base (197)..(197): a, c, t, g, unknown or other
  modified_base (285)..(285): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagcaacttgcctggtaccagcaagaacctggccaggcctcccaggcctcctnattctatcgctgcactcccacgacgggccagtcggtactcccgagtcctaggttcaggtggactaggtcgggtctgggggactaggtacgttcacgttcctacgaccctatacaggcacgtccttgacgtacgttcgtaaggtaacgttacgtttttcggaacctttaaagttttttacggttaaccgttggttaaccaagggttaccttaaaggtttaaactttaaacgtttaaccgggttgggggtttaccgggtaaccggtttaccgggggaaaccgtaaaacgggggtaacccgttaaaagggggtttaaacaaaacgttaaccgtaaaacgggttaacgtttcggggttaacgggtcctttacgggaacccttaacccgttagttacccgtttaacggttcctttaacccgg

SEQ ID NO: 442233 - DNA, 610 bp, Homo sapiens
  misc_feature: GZ8MTXP01ACY32.2.7.A07.1.454.CMB.2.raw
  modified_base (196)..(196): a, c, t, g, unknown or other
  modified_base (205)..(205): a, c, t, g, unknown or other
  modified_base (288)..(288): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaangccaccctntcctgcagggccagtcagagtatagcagcaacttagcctggtaccagacaagaaacctgggccaggcctcccgaggcctcctnatctatgctgcactcccaccgagggccctacgtggtactccccgagtccctaggttcaggtggcaggtcgggtctggggacaaggtagtttcactttcacaacccgtatccgagccgaacgtcccctggactacggtcttagtaaagttattttacggactttaaagtttagttactgttacagtactaagttataagttaacgtgggtacggtaccgttcggaccgaaaggggtaaccttaaaggggtaacaaacgttaacgaaaacggttaacgttggttacgtctacgaacctaacctattacgtcgttaacttaaccg

SEQ ID NO: 442234 - DNA, 611 bp, Homo sapiens
  misc_feature: GZ8MTXP01AXESJ.2.7.A07.1.454.CMB.2.raw
  modified_base (197)..(197): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaaccnggccaggcctcccgaggcctcctcatctatgctgcatcccacgagggcccacgtggtactcccgagcctaggttcaggtcggcagggtcgggtctgggggactagggtagtttccatttccgacaacctataccgaggcacggtcccttggacctagttcgtaggtaaagttattttacgactttaaattttacgttaacttggtacaaggtctaaagttaattaaagttaaccgttgggtacggtaccggttaccgggaccgaaaggggtaaccttaaaggggtaacgaaacgtacgaaaacggttacgttggttacgctgaacctactagttcttcgttcttaacg

SEQ ID NO: 442235 - DNA, 596 bp, Homo sapiens
  misc_feature: GZ8MTXP01CN57Y.2.7.A07.1.454.CMB.2.raw
  modified_base (199)..(199): a, c, t, g, unknown or other
  modified_base (270)..(270): a, c, t, g, unknown or other
  modified_base (293)..(293): a, c, t, g, unknown or other
  modified_base (449)..(449): a, c, t, g, unknown or other
  modified_base (534)..(534): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaanacgcccaccctctcctgcgagggccagtcagagtatagcagctaacttagcctaggtaccagcaagaaccnggccaggcctcccaggcctcctnatctatgctgccactcccaaccgacgggcccaacgttcggtaacctccccgacgcccgtacgggttcaggttcgggcgtagggttcggggtctgggggactaggtacgttctaagttctaccaacctatcaggcagccctgctagtctagtaattntttagacttaattttatactgtacagactaagtaataagttaacgtggtacgtacgtcggaacgaaagggtaacaaagggtaaanaaacgtaacgaaagttacgttggttacggtctagaactaccgtattccgttcgttccttaac

SEQ ID NO: 442236 - DNA, 601 bp, Homo sapiens
  misc_feature: GZ8MTXP01CBOJ2.2.7.A07.1.454.CMB.2.raw
  modified_base (198)..(198): a, c, t, g, unknown or other
  modified_base (209)..(209): a, c, t, g, unknown or other
  modified_base (272)..(272): a, c, t, g, unknown or other
  modified_base (296)..(296): a, c, t, g, unknown or other
  modified_base (449)..(449): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaaancgcccaccctntcctgcaagggccagtcaagtagtattagcagctaacttagcctaggaccagacagaaaccgnggccaggcctccgaggtcctcctnatctatgctgcaactccgaccgacgggcctaacgtggtaactccccgagcccgtaaggttccaggtcggcctaggggttgggtccgtaaggggactaagtacgttcactttcacacctagcaagcagcctggactagtctagtaatgttttanaattaatttagtactgacagatagtaataagtagtacggtaggtacggtacggaacggaacggtaaacggaaaggtaaacgaaacgtaaacgtaaacgaacgttaggttacgtaacgtacgtaacgtacgtacttacttcgttcgttaaccg

SEQ ID NO: 442237 - DNA, 521 bp, Homo sapiens
  misc_feature: GZ8MTXP01B3X9G.2.7.A07.1.454.CMB.2.raw
  modified_base (197)..(197): a, c, t, g, unknown or other
  modified_base (262)..(262): a, c, t, g, unknown or other
  modified_base (375)..(375): a, c, t, g, unknown or other
  modified_base (405)..(405): a, c, t, g, unknown or other
  modified_base (418)..(418): a, c, t, g, unknown or other
  modified_base (480)..(480): a, c, t, g, unknown or other
  modified_base (500)..(500): a, c, t, g, unknown or other
  modified_base (510)..(510): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttgcctggtaccagcagaaaccnggccaggcctcccaggcctcctcatctatgctgcactcccaccgagggcccacgtggtactccccagcctaggttcaggtggcaggtgggtctggggacaggtattcatttcncaccatcagcagcctgcagtctagaagttntttgattaatttntactgtcagtctaagtataataacgtggtaggtacgttcggaccgaagggaccaaagggtanaaacgtacgaaagacgttgnggctgcactnttctgttcctc

SEQ ID NO: 442238 - DNA, 735 bp, Homo sapiens
  misc_feature: GZ8MTXP01AFROQ.2.7.A07.1.454.CMB.2.raw
  modified_base (197)..(197): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangcccaccctctcctgcagggccagtcagagtatagcagcaacttgcctggtaccagcagaaccnggccaggctcccaggcctcctcatctatgctcgcactcccgaccgacgggccctacgtcggtactcccgagccgtaggttccaggtcggcgtagggttcggggtcgtcgggggaactagggtaagtttcctaacgtttcctaccgaaccctacgttccaacggaccgtaacggtcccttaggcccgtaaggtttaccgttaggtaaagtttactttttaggtaacctttaaaagttttttaacgtttaacccgtttaggttacctaacggtacttaaaggtttaaattaaacggtttaaaccggttgggggttaacgggtaaccggtttacccgggggaacccggtaaaacgggggtaaacccgttaaaaggggttaaacgaaaaacgttaaccggaaaaaccggttacgttcgggttacggtaaccttacggaaccctaccgtaacttccggttaacgttcccgtttaacccg

SEQ ID NO: 442239 - DNA, 725 bp, Homo sapiens
  misc_feature: GZ8MTXP01DE84Q.2.7.A07.1.454.CMB.2.raw
  modified_base (197)..(197): a, c, t, g, unknown or other
  modified_base (707)..(707): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgccacctctcctgcagggccagtcagtagtatagcagactaacttacgccgtaggtaccagacgaacgaaccgtcggaccgacggccctacccgacggtccctccctatacttctagtcgtactcgacctaacctaccccgaaccggacccgggtaccctacggttccggttaaccctccccgacggtacccgttagggttaccgtaggtcggggaccgtaggggttcggggtacgtaagggggaactaacggtacgttactacttcctaccacctagtccgaagtccgacggtccgtagacgttacgttacgtaacgtaagtttactttacgtaactttaaagttttaccgtttaagtacggtactaagttacgtaaagtttacttaaagttaacgggttggtaacgggttaccgtacggggaaccggtaaagggtaaccggttaaaggttaaacgaaacgtaaaccgtaacggttaacgttggaccggtaacacggtaaccacgtnttacttccgttctaaccg

SEQ ID NO: 442240 - DNA, 526 bp, Homo sapiens
  misc_feature: GZ8MTXP01EBWFO.2.7.A07.1.454.CMB.2.raw
  modified_base (199)..(199): a, c, t, g, unknown or other
  modified_base (268)..(268): a, c, t, g, unknown or other
  modified_base (318)..(318): a, c, t, g, unknown or other
  modified_base (412)..(412): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanacgccaccctctcctgcagggccagtcagagtattagcagcaacttagcctggtaccagcaagaaaccnggccaggctcccaggctcctcatctatgctgcatccacagggccatgacnccagccaggtcagtgcagtgggctgggacaggattcattctcacatcagcagcctgcagtctgaagtatttagtataatttaagttattagtanagatagtaataataagtaggtggtacgtacgacgaacggaacgaaagtaaagaaagtaaacgaaacgaaacgttaggttaggtaacgtacgaacactacttacttcgttcgttc

SEQ ID NO: 442241 - DNA, 836 bp, Homo sapiens
  misc_feature: GZ8MTXP01CY54H.2.7.A07.1.454.CMB.2.raw
  modified_base (197)..(197): a, c, t, g, unknown or other
  modified_base (260)..(260): a, c, t, g, unknown or other
  modified_base (289)..(289): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccacctctcctgcagggccagtcagagtatagcagcaacttgcctggtaccagcaagaacngcacggctcccacggctcctctactactntacgctcgtacactccgtaacccgacgggtaccgaccgttacggtaccgttaccccgacgtacccgtaaccgggtttaccgtaacggtcggggtccgaacggggtttcgggggttaccgggtcgggggtaacgtaaacgggttaaacggggttttaccgtaactttccccggtttaccaaacccctacgtttaccgaacggtacccgacgggtccccttacggacgtaccgtttagttacggtaaaaggttactttttaggtaacctttaaattttaattttaaccgtgttaacgtaaccgtaacgttaaagttaaagttaaacgtttaaaaccgggttgggggttacgggttaaaccccggggttttaccggggtaaaccccggggaaaaaacgggggttaaaccccggaaaaagggggtttaaacggaaaaaccgtttaaaccgggaaaaacccgggttaaaaacgttcggggttaacgggtaacgtaacccgggtccgttaaaccctaaccgggtttcttaaccggtttcccgttttaaccccg

SEQ ID NO: 442242 - DNA, 570 bp, Homo sapiens
  misc_feature: GZ8MTXP01CRCBW.2.7.A07.1.454.CMB.2.raw
  modified_base (195)..(195): a, c, t, g, unknown or other
  modified_base (260)..(260): a, c, t, g, unknown or other
  modified_base (507)..(507): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctccagatgccactggagaagtggtgatgacgcagtctccagccacctgtctgtgtctccgaaggggaaancgccacctctctgcagggccagtcagagtatagcagcaacttgcctaggtaccagcaagaaaccnggaccaggcctacccgaggcctcctcatctatgctgctactccaccgagggccacgtggtactcccgagcctaggttcaggtggctaggtcgggtctggggactaggtacgttcattcacactatcagcacgcctagctagtctagtaagttacttttagaactttaaattttacttaacgttgtacagtactaagtaactaagtacgtggtagtacggttcgaacgtaagggtaacaagggttaanaacgtaaacgaagttaacgttggttacgaactacgaactaccgtattccgtaagttcttaacg

SEQ ID NO: 442243 - DNA, 636 bp, Homo sapiens
  misc_feature: GZ8MTXP01AQQVV.2.7.A07.1.454.CMB.2.raw
  modified_base (198)..(198): a, c, t, g, unknown or other
  modified_base (265)..(265): a, c, t, g, unknown or other
  modified_base (404)..(404): a, c, t, g, unknown or other
  modified_base (441)..(441): a, c, t, g, unknown or other
tcagacgctcgacacacgaccggtgctcgatttagcacgtgtcgcgagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangcccaccctctcctgcagggccagtcagagtatagcagctaacttagcctggtaccagcaagaaccnggaccaggcctcccaggcctcctcatctatcgctgccactcccacgacgggccctacgtcggtactcccaggtccctagggttccaggtggcgtagggtcgggtctggggacagggtacgttctactttccacaacctntacaaggcacggccttggacctagttctagtaagttnttttacgaactttaaagttttacttacgttgtacctaaggtactaagttaaacttaaacgttacggtgggttaccggtaaccggtttaccggggaacccgtaaaagggaaccgttaaagggtaaacgaaactaaccgaaaacggttacgttggacggtctacggtaaccaaccgtattcctaacgttcttaaccg

SEQ ID NO: 442244 - DNA, 511 bp, Homo sapiens
  misc_feature: GZ8MTXP01EDWYI.2.7.A07.1.454.CMB.2.raw
  modified_base (263)..(263): a, c, t, g, unknown or other
  modified_base (284)..(284): a, c, t, g, unknown or other
  modified_base (391)..(391): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacnggccaggctcccaggctcctnatctatgctgcatcccacagggccactggtactcccagccaggttcagtggcaggtgggtctggggacagagttcattctcacatcagcagcctgcagtctgaagtntttgacttaatttattactgtacagctaagtataaataacgtggtaggtacgttcggactaaaggggacaaaggtagaaatacgaaaaggacttggttaggctgcactattctgttcttc

SEQ ID NO: 442245 - DNA, 586 bp, Homo sapiens
  misc_feature: GZ8MTXP01DHMBU.2.7.A07.1.454.CMB.2.raw
  modified_base (195)..(195): a, c, t, g, unknown or other
  modified_base (261)..(261): a, c, t, g, unknown or other
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaanacgccaccctctcctgcagggccagtcagatatagcagcaattagcctggtaccagcaagaaaccnggccaggcctcccgaggcctcctnatctatcgctgcatcccacgagggccacgtgtactcccagcctaggttcaggtggactaggtgggtactggggaactaggtacgtttcacttcctacaacctatcagcacgccctgactagttcgtagtaaagttattttgaacttaacttttattaacgttgttaccagtactaagttaataagttaacgttgggtacggtacgttccggaaccgtaaagggtaaccgaaagggtaaacgaaattacgaaacgttaacgttggttagtaacgagtaacacctgttacttcgttcttaacc

SEQ ID NO: 442246 - DNA, 669 bp, Homo sapiens
  misc_feature: GZ8MTXP01EIND8.2.7.A07.1.454.CMB.2.raw
  modified_base (196)..(196): a, c, t, g, unknown or other
  modified_base (336)..(336): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagcaacttagcctaggtaccagcaagaacctggccaggcctcccgaggcctcctcatctatcgactgactactcccgaacgacggggcctacgtcggttaaccnccccgaaggtcccgtaagggtttccaaggggttcgggaccgtagggttcgggggtccgtgggggaacctaggtacgtttctaactttcctacaaccctattcaaggcaacgtcctaggacctaggttacgtaggtaaagttattttggaactttaaatttttatttacgtggttactaaggtctaaagttaattaaacgttaacgtgggtacgggtaccgttaccgggaacggtaaaaggggtaaccgttaaaggggtaaacttaaaacgtacgtaaaaacgacgttgggttacggctacgaacctaacctagttccttcgttcctttaaccg

SEQ ID NO: 442247 - DNA, 638 bp, Homo sapiens
  misc_feature: GZ8MTXP01DI66O.2.7.A07.1.454.CMB.2.raw
  modified_base (261)..(261): a, c, t, g, unknown or other
  modified_base (618)..(618): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcagggccagtcagagtatagcagcaacttgctggtaccagcaagaaccnggaccaggcctacccgaggcctcctcattctatcgctcgacctactcccgaaccgacggggcccaacgttcggtaacctcccccgaggccccgtaagggtttccaggttcgggacctagggttcgggggttctgggggactaagggtacgtttccaacgtttcaccgaccctatacgacgcgacgtcccgtgacgtagttctagaacgttatttgaacttaattttacttaacgtgtaccagtactaagttaattaagttaacgtggtacggtacgttcgggaacgtaaagggaaccaaagggtaacaaacgttaaccaacggttaacgttggttaacggctacgaaccgaaccttnttaccgttgttccgttaacg

SEQ ID NO: 442248 - DNA, 590 bp, Homo sapiens
  misc_feature: GZ8MTXP01AT976.2.7.A07.1.454.CMB.2.raw
  modified_base (197)..(197): a, c, t, g, unknown or other
  modified_base (533)..(533): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtatagcagcaacttagcctggtaccagcaagaacctggccaggctcccaggctcctcatctatgctgcactcccaccgagggccctacgtggtactccccagccctaggttcaggtggctaggtggggtctggggactagggtacgtttcagttttccacaaccctatccaaggccagcccttaggacctagttctagtaagttattttgaactttaaatttaggttaactgtacagtactaagttaataaagttacgtgggtacggtaccgttcggaccgaaaggggaaccttaaagggtaaanaaacgtaaccgaaacgttagttggttacggtctcgaacctactagttctcgttctcg

SEQ ID NO: 442249 - DNA, 640 bp, Homo sapiens
  misc_feature: GZ8MTXP01D1TO3.2.7.A07.1.454.CMB.2.raw
  modified_base (195)..(195): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaancgccaccctctcctgcacgggccagtcagagtatagcagctaacttacgcctggtaccagacaagaaaccnggccaggcctcccgaggtcctcctcatctatgctcgacactccgacgacgggccacgtggtacctcccgagcccgtaggttccaggtcggcgtaggtcggggtctaagggggactaggtacgttcagtttccacacctatcgacgtcagtccgtagaccgtagttctagggtaacgttatttacgaactttaagttttacttacgttgtacagtactaagttaattaacgtaacggtgggtacgggttaccgttaccggggaaccgtaaacggggtaaacgaaaggggttaacttaaaacgtacggaaaacgttaacgttcggttacgggaacttcgaaccgttacctattccgtttaacgttcctttaacccg

SEQ ID NO: 442250 - DNA, 561 bp, Homo sapiens
  misc_feature: GZ8MTXP01D8J9L.2.7.A07.1.454.CMB.2.raw
  modified_base (196)..(196): a, c, t, g, unknown or other
  modified_base (265)..(265): a, c, t, g, unknown or other
  modified_base (305)..(305): a, c, t, g, unknown or other
  modified_base (318)..(318): a, c, t, g, unknown or other
  modified_base (369)..(369): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanacgccaccctctcctgcagggccagtcagagtattagcagcaacttagcctggtaccagcaagaaaccnggaccaggcctccaggctcctcatctatgctgcatccacngggccactgtacnccagccaggttcagtgcaggtcgggctggggactagtacgtttcactttcncaacctatcaagcagcctggactacgtctagtaacgttatttgacttaaattttatacttgtacagtactaagttactaaagtacgttgggtacggtacgttcgggacgaaagggtaccttaaagggtaagaaagtaccgaaacggttaacgttggttacggctagaacgtaccattcctaagttccttaac

SEQ ID NO: 442251 - DNA, 505 bp, Homo sapiens
  misc_feature: GZ8MTXP01B389K.2.7.A07.1.454.CMB.2.raw
  modified_base (197)..(197): a, c, t, g, unknown or other
  modified_base (263)..(263): a, c, t, g, unknown or other
  modified_base (363)..(363): a, c, t, g, unknown or other
  modified_base (463)..(463): a, c, t, g, unknown or other
  modified_base (483)..(483): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaccnggccaggctcccaggctcctcatctatgctgcatccaccagggccactggtactcccagccaggttcagtggcaggtgggtctgggacagagttcattcncaccatcagcagcctgcagtctagaagtatttgacttaatttattactgtcagctagtataataacgtggtggtacgttcggacgaagggacaagggtanaaacgtacaaacgacgttgnggctgcacctattctgttcttc

SEQ ID NO: 442252 - DNA, 550 bp, Homo sapiens
  misc_feature: GZ8MTXP01CXIXN.2.7.A07.1.454.CMB.2.raw
  modified_base (197)..(197): a, c, t, g, unknown or other
  modified_base (266)..(266): a, c, t, g, unknown or other
  modified_base (423)..(423): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagcaacttagcctggtaccagcaagaaaccnggccaggcctcccaggcctcctcatctatgctgcatcccacgagggcccacgtggtactccccgagccgtaggttcaggtggctaggtggggtctggggacagggtacgtttcagtttcctacacccatcagcagcctgactagtctagtaaagttntttagacttaattttagttactggttacagtactaagttaataataacgtggtacggtacgttcggaacgaaacgggacaaaggtagaaatacgaaagacgttgacgctgctactattctgttcttc

SEQ ID NO: 442253 - DNA, 591 bp, Homo sapiens
  misc_feature: GZ8MTXP01D58OF.2.7.A07.1.454.CMB.2.raw
  modified_base (197)..(197): a, c, t, g, unknown or other
  modified_base (265)..(265): a, c, t, g, unknown or other
  modified_base (424)..(424): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagcaagaaaccnggaccaggcctcccgaggcctcctcatctatgctgcatcccacgacgggccctacgtggtactcccgagccgtaggttcaggtggcgtaggtcgggtctggggactaggtagttcattccacgaccatcgagcacgccttgacctagttctagaagttntttagacttaattttagttactgtacagtctaagttaataagtacggtggtacggtaccgttcgggaaccgtaaagggaaccgttaaagggtaaagaaacgtaccgaaaaacgttacgttggttacggtctacggtaaccacctagttaccttcggttctttaaccg

SEQ ID NO: 442254 - DNA, 710 bp, Homo sapiens
  misc_feature: GZ8MTXP01APWK6.2.7.A07.1.454.CMB.2.raw
  modified_base (197)..(197): a, c, t, g, unknown or other
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaacctggccaggctcccaggccctctanactctatcgctcgctacctacccgaccggacgggccctacggttacggtacctacccgacgccgttacggttacgaggtcggacgtggttcgggtcggtcggacgtaaggttacgttactacgtttccacctaacacttcgacgtacgaccgttccgtagtaccgtacgttcgttaagggtaacttttagtttacgaacttttaaatttaactttcgtacgtacgtaccggttaacgtaaagttttaaactaaaccggtttagggttacggggttaaacccgggttaccggttaacccggggtaacgggaaaaccggggtaaaccggttaaaagggtaaagttaaacccgttaaacggaaaaccgttaggttcggacgtaaccgtcgaactcccgtaggtttccgttaacgtttaacccgttccg

SEQ ID NO: 442255 - DNA, 714 bp, Homo sapiens
  misc_feature: GZ8MTXP01EHZ3Y.2.7.A07.1.454.CMB.2.raw
  modified_base (195)..(195): a, c, t, g, unknown or other
  modified_base (270)..(270): a, c, t, g, unknown or other
  modified_base (302)..(302): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccatggagaagtggtgatgacgcagtctccagccaccctgtctgtgtctcggaagggaancgccaccctctcctgcgaggccagtcagagtatagcagactaacgttagccgtggtaaccagacaacgaaaccgnggaccacggccctacccgaggccctaccctanacttctagtcgctgaccactacccacggacgggtcctagtacgtactcccgagccgtacggttcgaggtggacgtagggttcggggactggggaactaggtacgtttcacttccgtacaacactacgacgtcgaacgtccgtacgtacgtacgttcgtaaggttaaatttacgtttagttaaacctttaatttttaacgtttacgttacgtaagtaacgttacgttaaaggttaaatttaaacggttaaccgggttacggggttaaccgggttaacccgggtttaaccggggaaacccggtaaaacggggtaaaccggttaaaagggtaacgttaaaaaccgaacggtaaaaccgttggttagttacggtaactacgtaacctaacgtacttcgttaaccgttcgttaaccg

SEQ ID NO: 442256 - DNA, 784 bp, Homo sapiens
  misc_feature: GZ8MTXP01C1VPY.2.7.A07.1.454.CMB.2.raw
  modified_base (193)..(193): a, c, t, g, unknown or other
  modified_base (261)..(261): a, c, t, g, unknown or other
  modified_base (293)..(293): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctccgagggaancgccacctctctgcgagggccagtcagatatagcagctaacttgccgtggtaccagacaacgaaaccnggaccacggcctacccgacggtcctacccgtnaacttcctagtcgtccgtacgcctaactaccccgaaccggacgggggtacccctaacgttacgggtaacctccccgaggtcccgttaacgggtttcgagggtcgggaccgtagggttccgggggtacgttcgggggaactacgggttacggtttaccgtaacgtttccctacccgaaaccctacgttaccgaacgggtaccgaacggtccccgttaggaccgttaacgggtttaccgtaaagggttaaacggtttatttttacggtaaaccttttaaaaggttttttactttaaccgttacggttaactaacgggtaaccttaaagggttaaacctttaaaggttaaacgggttcgggttaacgggttaaccgggttaccggaaaccgggtaaaacgggtaaccgttaaaggggtaaacaaacgtaaaccgtaaacgttacgttgggttacggtaactacggcctacgtacgttacgttcgttcttaaccg

SEQ ID NO: 442257 - DNA, 606 bp, Homo sapiens
  misc_feature: GZ8MTXP01EQM3C.2.7.A07.1.454.CMB.2.raw
  modified_base (200)..(200): a, c, t, g, unknown or other
  modified_base (265)..(265): a, c, t, g, unknown or other
  modified_base (283)..(283): a, c, t, g, unknown or other
  modified_base (320)..(320): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaancgccaccctctcctgcagggccagtcaagagtattagcagcaacttgcctggaccagcagaaccnggccagctccaggctccnatctatgctgcatcccacgcgggcctagtggttaccnccgagtccgtaggttcgaggtcggacgtagggtcgggtacgtggggaactagggttacgtttctactttcctaccgaacctatacgacgcacgtccgtgacgtagttactaggtaagttatttagaactttaaattttacgtacgtgtacagtactaagttaataaacgttaggtgggtacggtaccggttacggaacgaaagggtaaccttaaaggtaaacgaaacgtaacgaaacgttacgttggttacgaactacgaacctacgtgttaccttcgttctaacg

SEQ ID NO: 442258 - DNA, 607 bp, Homo sapiens
  misc_feature: GZ8MTXP01AWXD1.2.7.A07.1.454.CMB.2.raw
  modified_base (197)..(197): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgcagggccagtcagagtatagcagcaacttagcctggtaccagcaagaaccnggccaggctcccgaggcctcctcatctatgctgcatcccacgacgggccacgttggaactcccagccctaggttcaggtgcaggtcgggtctggggacaggtagtttcatttcacaccatcagcagcctgcagtctagaagttatttgacttaattttactaactgtactaagtctaagttaattaaacgttaacggttgggtacggtaaccggttacgggacccgtaaaagggggacccaaaaggggtttaaacgaaaacgttaccgaaaaacgggttaccgttgggttacgggaacttgggaacccttaaaccgtacttccgttaacgttaacccttttcg

SEQ ID NO: 442259 - DNA, 673 bp, Homo sapiens
  misc_feature: GZ8MTXP01C76XS.2.7.A07.1.454.CMB.2.raw
  modified_base (197)..(197): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaancgcccaccctctcctgcagggccagtcagagtatagcagcaacttgcctggtaccagcagaaccnggcaggcctccaggcctcctcatctatcgctgcactcccaaccgacgggcccacgtggtacctcccgagccctaggttcaggtcggcgtaggtcgggtcgtggggactaggtacgttactacgttcctaccaacccattcgaacgtccgacgtccctagactacgttactaggtaaacgttagttttacgactttaaattttacgtttaaccttaggtaccaacggtacttaaaagttaagttaaaacgttaaccgggttgggttaacgggtaaccgggtttacccgggaaaccggtaaaacgggggtaacccgttaaaagggtaaacgaaaacgttaaccgaaaaacggttaacggttgggttacgggtcttacggaacctaacctgttaccgttcgttaacctttcccg

SEQ ID NO: 442260 - DNA, 524 bp, Homo sapiens
  misc_feature: GZ8MTXP01E4M7O.2.7.A07.1.454.CMB.2.raw
  modified_base (196)..(196): a, c, t, g, unknown or other
  modified_base (263)..(263): a, c, t, g, unknown or other
  modified_base (283)..(283): a, c, t, g, unknown or other
  modified_base (363)..(363): a, c, t, g, unknown or other
  modified_base (391)..(391): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggcaggctcccaggctcctnatctatgctgcatccaccagggccacgtggtatcccagccaggttcagtggcaggtgggtctggggacagagttcattcncacatcagcagcctgcagtctagaagtnttttgactaatttattactgtcagctaagtaataaataacgtggtggtacgttcgggaccgaaaggggaaccaaagggtaacgaaaagtacgaaaacgacgttggttacgggctgccacattctgttcttaac

SEQ ID NO: 442261 - DNA, 517 bp, Homo sapiens
  misc_feature: GZ8MTXP01CWQPF.2.7.A07.1.454.CMB.2.raw
  modified_base (196)..(196): a, c, t, g, unknown or other
  modified_base (261)..(261): a, c, t, g, unknown or other
  modified_base (281)..(281): a, c, t, g, unknown or other
  modified_base (359)..(359): a, c, t, g, unknown or other
  modified_base (387)..(387): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcagaaaccnggcaggctcccaggctcctnatctatgctgcatccaccgagggcccatggactcccagccaggttcagtgcaggtgggtctgggacagagttcattcncaccatcagcagcctgcagtctagaatntttgacttaatttattactgtcagctagtataatacgtggtcggtacgttcggacctaaggggaccaaagggtacgaaagtacgaaacgacgttggttacggctaggcctaccagttctaagttcttaac

SEQ ID NO: 442262 - DNA, 634 bp, Homo sapiens
  misc_feature: GZ8MTXP01BQRTF.2.7.A07.1.454.CMB.2.raw
  modified_base (197)..(197): a, c, t, g, unknown or other
  modified_base (263)..(263): a, c, t, g, unknown or other
  modified_base (283)..(283): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtattagcagcaacttagcctggtaccagcagaaccnggccaggctccaggctcctnatctatgctgcatcccacgacgggccacgtggactcccagcctaggttcagtggcgaggtgggtctggggactaggtagttcatttccgtcaacccatccagtcacggtccctgaccgtagttcctaaggtaagttatttttcgaacttaaatttttacttaacgttggtaccaggtactaaggttaacttaaagttaaccggttgggtacgggtaaccgtttccggggaacccgtaaagggggtaacccgaaagggggttaaacaaaacgtaacccgtaaaaacggttaacgttcggttaggggtaacctaggtaaccctaacgtacttccgttaacgtttcccttaacg

SEQ ID NO: 442263 - DNA, 608 bp, Homo sapiens
  misc_feature: GZ8MTXP01ATD37.2.7.A07.1.454.CMB.2.raw
  modified_base (196)..(196): a, c, t, g, unknown or other
  modified_base (265)..(265): a, c, t, g, unknown or other
  modified_base (543)..(543): a, c, t, g, unknown or other
  modified_base (574)..(574): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanacgccaccctctcctgcagggccagtcagagtattagcagctaacttagcctggtaccagcaagaaccnggccaggcctcccgaggcctcctcatctatgctgcatccccacgacgggccctacgtcggtactcccgagccgtacggttcaggtggacgtagggtgggtccgtggggactaggtacgttcacgtttcctacaaccctatcaacggtcacggtcctggaccgtagtcttagtaagttacttttagactttaaattttacttactgtaccaagtactaagttaactaagttaacgtggtaggtaccgttcggaacgaaggggtaaaccaaggggtaaanaaacgtacgaaaacgttacgttgttacgggntacggaactaaccctattctaacgttccgttaac

SEQ ID NO: 442264 - DNA, 536 bp, Homo sapiens
  misc_feature: GZ8MTXP01EHUUG.2.7.A07.1.454.CMB.2.raw
  modified_base (198)..(198): a, c, t, g, unknown or other
  modified_base (263)..(263): a, c, t, g, unknown or other
  modified_base (280)..(280): a, c, t, g, unknown or other
  modified_base (315)..(315): a, c, t, g, unknown or other
  modified_base (377)..(377): a, c, t, g, unknown or other
  modified_base (484)..(484): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaaancgccaccctctcctgcagggccagtcagagtatagcagctaacttagcctggtaccagcagaacnggcaggctccagctccnatctatgctgcactccacgacgggccactggtacncccgagccaaggttcaggtgctaggtgggtctggggacaggagtttcagttctcaccatcancagcctgactagtctagaagttatttgacttaatttatactgtacagtctaataataaagttaacgtggtacgacgttcggacgtaaacgggaacttaagggtaaanaaagtacgaaagttacgttgttacgaactgaacctactacttctgttctaac

SEQ ID NO: 442265 - DNA, 565 bp, Homo sapiens
  misc_feature: GZ8MTXP01C3VFY.2.7.A07.1.454.CMB.2.raw
  modified_base (196)..(196): a, c, t, g, unknown or other
  modified_base (258)..(258): a, c, t, g, unknown or other
  modified_base (275)..(275): a, c, t, g, unknown or other
  modified_base (311)..(311): a, c, t, g, unknown or other
  modified_base (412)..(412): a, c, t, g, unknown or other
  modified_base (506)..(506): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctccgaaggggaaancgcccacctctctgcagggccagtcagtagtatagcagcaattgcctggaccagcaagaacnggcagctccagcctctnatctatgctgacactccacgagggccacgtggtacncccgagccgtaggttccgaggtcggacgtaggttcggggtctggggactaggtagttcatttccacacagtcagcagtcctgactaggtctagtaaagttntttagactttaaagtttcgttactgtacaagtataagtaataaagtacgtggtacggtacgtcggaaccgtaaagggtaacttaaagggtaaanaaacgtaacgaaacgttacgttggttacgtaactacgcctaactgttcgttcgttcctc

SEQ ID NO: 442266 - DNA, 693 bp, Homo sapiens
  misc_feature: GZ8MTXP01AVP62.2.7.A07.1.454.CMB.2.raw
  modified_base (197)..(197): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaccngcagctccgagctctcatctatgctgcatcccgacgacgggccctacgtggtacctccccgagtcccgtaagggtttccaggttcgggctaggggttcggggtacctgggggaaactagggtacgtttctaacttttccgacctaacccgtatccgaacggccctaacggtcccttaggacccgtaggtttaccgtaaggtaaagtttactttttacggaaccttttaaagtttttacgtttaaccgttaggttaacctaaggtaaccgttaaaggttaatttaaaacggttaaaccggttggggttaacgggtaaccggtttaccggggaacccggtaaaagggggtaaacccaaagggttaaacgaaacgttacgaaaacggttacgttggttacggctacggaacctacctagttctcgttcttaaccg

SEQ ID NO: 442267 - DNA, 520 bp, Homo sapiens
  misc_feature: GZ8MTXP01AKY49.2.7.A07.1.454.CMB.2.raw
  modified_base (197)..(197): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaaccnggccaggctcccaggctcctcatctatgctgcatcccacgagggcccactggtactcccagccaggttcagtggcaggtcgggtctggggacaggtagttcatttcacaccatcagcagcctgcagtctagaagttatttgacttaatttatactgtcagtcagtataatacgtggtgtacgttcggacgaaggggacaaaggtacgaaatacgaaaacgcgttggttcggcctagcctacattcgtaagttcttaac

SEQ ID NO: 442268 - DNA, 562 bp, Homo sapiens
  misc_feature: GZ8MTXP01D5P3D.2.7.A07.1.454.CMB.2.raw
  modified_base (196)..(196): a, c, t, g, unknown or other
  modified_base (265)..(265): a, c, t, g, unknown or other
  modified_base (288)..(288): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagtagtattagcagctaacttagcctggtaccagcaagaaccnggccaggctcccgaggcctcctnatctatgctgcactcccacgagggccacgtgtactcccagcctaggttcaggtcggctaggtcgggtctggggactaggacgtttcattccacaccatcagcagcctgactagtactaggtaattatttgaacttaaattttagttactgtacaagtacaagttataaagtacgtggtggtaccgttcggaacgaaagggtaccaaagggtaacaaagaacgtaaacgttacgttggttacggtctaggaacctactattcgtcgttcttaacc

SEQ ID NO: 442269 - DNA, 559 bp, Homo sapiens
  misc_feature: GZ8MTXP01C9NN6.2.7.A07.1.454.CMB.2.raw
  modified_base (259)..(259): a, c, t, g, unknown or other
  modified_base (279)..(279): a, c, t, g, unknown or other
  modified_base (375)..(375): a, c, t, g, unknown or other
  modified_base (403)..(403): a, c, t, g, unknown or other
  modified_base (409)..(409): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccacctctcctgcagggccagtcagagtatagcagcaattagcctggtaccagcagaaacnggccagctcccaggctcctnatctatgctgcaatcccaaccaggggcccaacgtggtaactccccaggccctaagggttcagtggcaggtggggtctgggacaggagttcatttcncaccatcagcagcctgcagtcagaagtnttttanacttaatttagtactgtacagactaagttaataaagttacgtgggtacggtaccgttacggaacgtaaagggaacgttaaaggtaaagaaacgtaaacgaaaacgttaacgttggttacgaactcgaaccactacttcttcgttctaacg

SEQ ID NO: 442270 - DNA, 641 bp, Homo sapiens
  misc_feature: GZ8MTXP01AMV8A.2.7.A07.1.454.CMB.2.raw
  modified_base (198)..(198): a, c, t, g, unknown or other
  modified_base (271)..(271): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccggaagggaaancgcccaccctctcctgcgacgggccagtcagagtatagcagctaacttgcctaggtaccagcaacgaaaccgnggaccacggcctcccgacggcctcctcatctatcgctcgacctacgtacccaccggacgggccctacggtaggtacctcccgagccgtacggttcgaggtggacgtagggtaacgggtagtggggactaggtacgttactactttccacaaacctactacgaacgcgacggccttagaccgtaagttctaggtaaattacgtttacaactttaattttagtacttgttacagtactaagttaataagtacgtgggtaggtacgttcgggaacgtaaagggaacaaagggtaaacaaacgtaaccgtaaaacgttacgttggttacgggtcctacgtaacgtaccctagttccttcgtttaaccgtttccg

SEQ ID NO: 442271 - DNA, 601 bp, Homo sapiens
  misc_feature: GZ8MTXP01C0UGV.2.7.A07.1.454.CMB.2.raw
  modified_base (195)..(195): a, c, t, g, unknown or other
  modified_base (264)..(264): a, c, t, g, unknown or other
  modified_base (441)..(441): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccgaggggaanacgccacctctcctgcagggccagtcagagtatagcagctaacttgcctaggtaccagcaacgaaaccnggaccagggcctacccgaggtcctccctacattcctatcgctgcctaactccccgaccgacgggcccacgtcggtactcccgagcccgtaggttcaggtggcctagggtcgggtctggggactagggtacgttcattcctacacctatcacgcacgcctgactagtctagtaagttntttagacttaatttagttactgtacagtactaagttaataagttaacgtggtacggtaccgttcgggaaccgaaacggggtaacttaaagggtaaacgaaacgttaacgaaacgttaacgttggttacggctacgaactaccgtattctgttcctttaac

SEQ ID NO: 442272 - DNA, 641 bp, Homo sapiens
  misc_feature: GZ8MTXP01BB3NT.2.7.A07.1.454.CMB.2.raw
  modified_base (198)..(198): a, c, t, g, unknown or other
  modified_base (265)..(265): a, c, t, g, unknown or other
  modified_base (422)..(422): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgccaccctctcctgcagggccagtcagagtatagcagcaacttagcctggtaccagcaagaaaccnggccaggcctcccaggctcctcatctatcgctgccatcccaccgagggcccacgtggtactcccagtcctacggttcaggtggcagggtcgggtctggggactaggagtttcagtttccacacccatcagcacgcctgactagtctaggtaacgttntttgactttaattttattacgttgtacctagtactaagttaagttaaacgtaacgttcggggtacgggttaaccggttccgggaaacccggtaaagggggtaacccttaaaagggggttaaacgaaaacgttaacgggaaaaaccgttaaccggttggggttacgggaaccttgggaaccctaaccctagtttcccgttaacggtttcctttaacccgg

SEQ ID NO: 442273 - DNA, 557 bp, Homo sapiens
  misc_feature: GZ8MTXP01AYX80.2.7.A07.1.454.CMB.2.raw
  modified_base (264)..(264): a, c, t, g, unknown or other
  modified_base (306)..(306): a, c, t, g, unknown or other
  modified_base (370)..(370): a, c, t, g, unknown or other
  modified_base (497)..(497): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtatagcagcaacttagcctggtaccagcagaaaccnggccaggctcccaggctcctcatctatgctgcatcccaccgngggcccagtcggtactcccagccaggttcagtcggcaggtgggtctgggacagtagttcattcncaccatcagcagcctgcagtctagaagtatttcgattaaatttattactgttacagtactaagttaataaagtaacgttggggtacggtacgttcggaccgtaaaggggaaccttaaaggggtaaanaacttaacgaaaccggattcgggttacgggctacgccactacttcgtcgttcgttaaccg

SEQ ID NO: 442274 - DNA, 557 bp, Homo sapiens
  misc_feature: GZ8MTXP01B5W56.2.7.A07.1.454.CMB.2.raw
  modified_base (194)..(194): a, c, t, g, unknown or other
  modified_base (263)..(263): a, c, t, g, unknown or other
  modified_base (432)..(432): a, c, t, g, unknown or other
  modified_base (512)..(512): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctcgaggggaanacgccaccctctcctgcagggccagtcagagtatagcagacaacttagcctggtaccagcaagaaaccnggaccaggcctacccgaggcctcctcatctatgctgcactccacgacgggccacgtggtactcccgagtccgtaacggttcaggtggcctaggggtcgggtcgtggggacagggtacgttcactttcgacaacctatcgagcacggcctggactagtctagtaaagttntttgaacttaattttataacgttgtacagtactaagtaactaagtacgtggtacgtacgtcggacgaaggaacaaggtanaaatacgaaacgttagttggagctcgctacgattcgtgttctaac

SEQ ID NO: 442275 - DNA, 544 bp, Homo sapiens
  misc_feature: GZ8MTXP01AJBH5.2.7.A07.1.454.CMB.2.raw
  modified_base (197)..(197): a, c, t, g, unknown or other
  modified_base (262)..(262): a, c, t, g, unknown or other
  modified_base (279)..(279): a, c, t, g, unknown or other
  modified_base (412)..(412): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttgcctggtaccagcagaaccngccagctccagcctctnatctatgctgcactcccgaccgagggccctacgtggtacctcccgagcctaggttcaggtggcaggtcgggtctggggactaggtacgttcagtttcacacctatcgagcacgcctgacagtctagtaagttnttttagacttatttatctgtcagtactaagtataagtaacgtggtgtacgttcggacgtaaagggaccaaaggtaacgaaatacgaaacgttagttgttaggtctacgaactacgtattctcgtttctaacc

SEQ ID NO: 442276 - DNA, 607 bp, Homo sapiens
  misc_feature: GZ8MTXP01DLDF9.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctcccagatgccactggagaagtggtgatgacgcagtctccagccaccctgtctgtgtctccgaggggaaanagccaccctctcctgcagggccagtcagagtatagcagctaacttgcctggtaccagcaagaaacctggtacacggcctcccgaggcctcctcatctatgctgcactcccaccgacgggccacgtggtacctccccgagtccgtacggttccaggttcggctagggtcggggtactgggggactaggtacgttcattctacaccatcagtcacgcctgctagtctagtaagttatttgacttaagtttacttactggtactagtactaagttataaagtacgtggtacgggtaccggttacggaaccgaaacggggtaaaccttaaagggtaaacgaaaacgttaacgaaaaccggttaacgttgggacggtaactacggaacctacctagttcttcgttaaccgttaacc

SEQ ID NO: 442277 - DNA, 550 bp, Homo sapiens
  misc_feature: GZ8MTXP01A5T20.2.7.A07.1.454.CMB.2.raw
  modified_base (196)..(196): a, c, t, g, unknown or other
  modified_base (283)..(283): a, c, t, g, unknown or other
  modified_base (361)..(361): a, c, t, g, unknown or other
  modified_base (370)..(370): a, c, t, g, unknown or other
  modified_base (399)..(399): a, c, t, g, unknown or other
  modified_base (489)..(489): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccaggctcctnatctatgctgcatcccacagggcccagtggtactcccgagtccaggttcaggtggcaggtcgggtctggggacagggngttcattcncaccatcagcagcctgcagtcagaagttntttgacttaagtttattcgtagttacagtcaagttactaaattaacgtgggttaggacgttcggcgtaaagggaccgttaaagggttaanaaacgttacaaaacggttacgttggacgggctaggcctaaccattcgtcggttccgtaacc

SEQ ID NO: 442278 - DNA, 832 bp, Homo sapiens
  misc_feature: GZ8MTXP01D0JJ3.2.7.A07.1.454.CMB.2.raw
  modified_base (199)..(199): a, c, t, g, unknown or other
  modified_base (266)..(266): a, c, t, g, unknown or other
  modified_base (288)..(288): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcgagggccagtcagagtatagcagcaacttgcctggtaccagacagaaccnggccaggcctccaggcctcctnatctatgctgcactcccgaccgacgggccctacgtcggtaacctccccgagtccccgtaagggtttcccgaagggtcggggacccgtaagggggttcgggggttacccgttaagggggggaaacctaaacggggtttaaccgggttttacgtaacccgttttacccgtaacccgtaaacccccttaagttaccccgaacggtacccgaaacggtcccccgttaggtaaccccgttaaggttaccgtaaggggttaaaaccttttaggtttttacgtaaaccttttaaaaggtttttttacgttaaacccgtttagggttaacctaaccgggtaaactttaaaggtttaaacttaaacgtttaaaacccgggtttggggttaaccgggtttaaacccgggtttaccgggaaccgggtaaaaacgggggtaaaccttaaaagggggttaaacaaaaacgtaaccggtaaaaacccgttaaaggttcgggttacgggaacctagggtaaccccgtacgtattacccgtttcggttcctttaaccccg

SEQ ID NO: 442279 - DNA, 565 bp, Homo sapiens
  misc_feature: GZ8MTXP01EZT4I.2.7.A07.1.454.CMB.2.raw
  modified_base (421)..(421): a, c, t, g, unknown or other
  modified_base (551)..(551): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtatagcagcaacttagcctggtacccagacaagaaaccgtggaccaggcctcccaggcctcctcatctatgctgcatcccaccgagggcccacgtggtactcccagcctaggttcaggtggcaggtggggtctggggacaggtagttcagtttcacacccatcgagcagcctgactaggttctaggtaaattntttagaacttaatttacgtacgtgtacagtataagttaattaagtacgtggtacggtacgtacggaacgtaaaggtaacgaaaggtaacaaagtaacgtaaagttacgttggttacgctacgaactactnttcgttcgttctcg

SEQ ID NO: 442280 - DNA, 552 bp, Homo sapiens
  misc_feature: GZ8MTXP01BZRTO.2.7.A07.1.454.CMB.2.raw
  modified_base (197)..(197): a, c, t, g, unknown or other
  modified_base (263)..(263): a, c, t, g, unknown or other
  modified_base (358)..(358): a, c, t, g, unknown or other
  modified_base (490)..(490): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccacctctcctgcagggccagtcagagtattagcagcaacttgcctggtaccagcagaaaccnggccaggctccgaggctctcatctatgctgcactccaccagggccactggtactcccgagcctaggttcaggtggctaggtcgggtctggggacnggtagttcagttcctcgactatcagcagcctgcagtctagagttcttgacttaatttctactgtacagctaagtaataagtaacgtggtacggtacgttcggaacccgtaaaggggaaccttaaagggttanaaacgtaccgaaacgttacgttgttacgggctaggaacctacgacttcggtcgttctaaccg

SEQ ID NO: 442281 - DNA, 533 bp, Homo sapiens
  misc_feature: GZ8MTXP01AWFP2.2.7.A07.1.454.CMB.2.raw
  modified_base (197)..(197): a, c, t, g, unknown or other
  modified_base (264)..(264): a, c, t, g, unknown or other
  modified_base (417)..(417): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaaaccnggccaggctcccaggctcctcatctatgctgcactccacgagggcccacgtggtactcccagcctaggttcaggtggcaggtgggtctggggacaggtagttcagttcacaccatcagcacgcctgcagtctagaagtatttgacttaatttnttaactgtacagtctaagtataatacgtggtaggtacgttcggacgaaagggaccaaagggtaagaaacgtacgaaacgagttggttcgaactgaaccacagttctcgttcttaac

SEQ ID NO: 442282 - DNA, 639 bp, Homo sapiens
  misc_feature: GZ8MTXP01B17VS.2.7.A07.1.454.CMB.2.raw
  modified_base (197)..(197): a, c, t, g, unknown or other
  modified_base (265)..(265): a, c, t, g, unknown or other
  modified_base (291)..(291): a, c, t, g, unknown or other
  modified_base (555)..(555): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagctggtaccagcaacgaaaccnggaccaggcctcccgaggtcctcctnactctatcgctgccactccccacgacgggcccacgtggtacctcccgagtcccgtacggttccaggtcgggctagggttcgggtcgtggggactaggtacgttcagtttccacaccatcagcagtcctgaccagttcgtaagtaacgttatttaggtacctttaaattttacgttacttaggttacaaggtacttaagttaataagttaacgtgggttacggtaccgttaccgggacgtaaacggggaacttaaacgggtaaanaaacgtaccgtaaaacggttaccgttggttaccgggtaactacggtaaccctaacgtacgttcttaaccggtttcctttaaccg

SEQ ID NO: 442283 - DNA, 561 bp, Homo sapiens
  misc_feature: GZ8MTXP01BRG87.2.7.A07.1.454.CMB.2.raw
  modified_base (196)..(196): a, c, t, g, unknown or other
  modified_base (548)..(548): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtattagcagcaacttagcctggtaccagcaagaacctggccaggcctcccaggcctcctcatctatgctgcactccacgagggccacgtggtactcccagccacggttcaggtggcaggtcgggtctggggactaggtacgttcattcgtacaccatcagcagcctgctagtctaggaagtattttgacttaaattttacttaacgttgtaccagtactagtaattaacgtaacgtggtacgttacggttacggaccgtaaagggaaccaaagggtaacaaacgttacgaaacgttacgttggttacgcctgaacaaccgtnttacgtcgttctc

SEQ ID NO: 442284 - DNA, 525 bp, Homo sapiens
  misc_feature: GZ8MTXP01A6GKF.2.7.A07.1.454.CMB.2.raw
  modified_base (198)..(198): a, c, t, g, unknown or other
  modified_base (265)..(265): a, c, t, g, unknown or other
  modified_base (322)..(322): a, c, t, g, unknown or other
  modified_base (374)..(374): a, c, t, g, unknown or other
  modified_base (482)..(482): a, c, t, g, unknown or other
  modified_base (514)..(514): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaattagcctggtaccagcagaaaccnggccaggcctccaggctcctcatctatcgctgcatcccacgagggccacgtggtacncccagccaggttcaggtggcaggtcgggtctggggactaggtagttcattcncaaccatcagcagcctggacagtctagtaatattttgacttaaagttttattacgtgtcagtactaagtataatacgtggtagacgttcgacgaagggacaagggtanaaagtacgaaacgttattggagctgaactacnttctcgttctc

SEQ ID NO: 442285 - DNA, 614 bp, Homo sapiens
  misc_feature: GZ8MTXP01DIXOH.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgcccaccctctcctgcagggccagtcagagtattagcagcaacttgcctggaccagcaagaaaccgtggccaggcctcccgaggtccctcctcatctatcgctcgacactccccgaccgacgggcccaacgtcggtactccccgagtcccgtaggttcaggtggcgtagggttcggggttacgtgggggactagggtaacgttcaactttctacacctatccgaaggtccacgtcctggactaggttacgtagtaaagttattttagaacttaattttagttacgttgtacagtactaagttaataagtaacgtggtacggttacgtacggaacgtaaagggtaacgaaaggttaacgaaagtacgaaacgttagttcggttacggcttagcctacattcgttcgttccttaacg

SEQ ID NO: 442286 - DNA, 709 bp, Homo sapiens
  misc_feature: GZ8MTXP01ELTLU.2.7.A07.1.454.CMB.2.raw
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaagacgccaccctctcctgcagggccagtcagagtattagcagcaacttgcctggtaccagcaagaaacctggccaggcctcccgaggcctcctnatcctatcgctgccaacgtccccaccgacgggccctacgtcggtactccccgagccgtacggttcaggtcggacgtagggttcggggtctgggggaacctagggtacgtttaccacgttttccacctaacctacgtacgacggaccgaacgtcccgtagtacccgtaggtttacgtaaggttaaagtttacggtttttagtaacctttaaatttttaacgtttaccgtttagggttaacctaacggtaacttaaaggttaaattaaacgttaaaccggtttggggttaacgggttacccggtttaccggggaaaccggtaaaacgggggtaaacccgaaaggggttaaacgaaacgtaaaccggaaaacgttacggttggttacggaacgtcgaacctactacttccgttcgttccttaacc

SEQ ID NO: 442287 - DNA, 582 bp, Homo sapiens
  misc_feature: GZ8MTXP01CFSDP.2.7.A07.1.454.CMB.2.raw
  modified_base (197)..(197): a, c, t, g, unknown or other
  modified_base (265)..(265): a, c, t, g, unknown or other
  modified_base (289)..(289): a, c, t, g, unknown or other
  modified_base (430)..(430): a, c, t, g, unknown or other
  modified_base (516)..(516): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagcaacttagcctggtaccagcagaaaccnggccaggcctcccgaggcctcctnatctatgctgcactcccaccgacgggcccacgtggtactcccgagccgtacggttccaggtcggcgtaggttcggggtctgggggactagggtacgtttcattccacacctatcagcacgcctgactagtctagtaagttntttgacttaatttatactgtcagtactaagttaataagttacgtgggtggtacgttcgggaacgaaaggggaacttaaagggtaanaaacgtacgaaaacgttacgttgggttacggtctacgaaccaacctgttcctaacgttccttaacg

SEQ ID NO: 442288 - DNA, 524 bp, Homo sapiens
  misc_feature: GZ8MTXP01DCMKS.2.7.A07.1.454.CMB.2.raw
  modified_base (196)..(196): a, c, t, g, unknown or other
  modified_base (261)..(261): a, c, t, g, unknown or other
  modified_base (487)..(487): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttgcctggtaccagcaagaaccnggccaggcctcccaggcctcctcatctatgctgcactccaccgacgggccacgtggtactcccgagcctaggttcaggtggcaggtgggtctggggacaggtagttcattctcacatcagcagcctgactagtctagtaatatttgacttaattttagttactgtacagtactaagttataattaacgtgggtacggtacgttcggacgaaagggacaaagggtanaaagtacaagaattgagctgcacattctgttcttaac

SEQ ID NO: 442289 - DNA, 562 bp, Homo sapiens
  misc_feature: GZ8MTXP01BA5HS.2.7.A07.1.454.CMB.2.raw
  modified_base (197)..(197): a, c, t, g, unknown or other
  modified_base (267)..(267): a, c, t, g, unknown or other
  modified_base (406)..(406): a, c, t, g, unknown or other
  modified_base (411)..(411): a, c, t, g, unknown or other
tcagacgctcgacacacgaccggtgctcgatttagcacgtgtcgcacggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccacccctctccctgcagggccagtcagagtatagcagcaacttagcctggtaccagcaagaaaccnggccaggcctcccaggcctcctcatctatgctgcatcccacgagggccacgtggtactccagccacggttcaggtggctaggtcgggtactgggacagtagttcattctcacatcagcagcctagcagtctagtaagtnttttnacttaatttagttactgtacagctaagtaataagttacgtgggtaggtacgttacggaccgaaagggaccgttaaagggtaacgaaactaaccgaaacgttacgttggttacggaacttcggaaccacctattccgtaacgttcttaaccg

SEQ ID NO: 442290 - DNA, 561 bp, Homo sapiens
  misc_feature: GZ8MTXP01EY131.2.7.A07.1.454.CMB.2.raw
  modified_base (198)..(198): a, c, t, g, unknown or other
  modified_base (262)..(262): a, c, t, g, unknown or other
  modified_base (368)..(368): a, c, t, g, unknown or other
  modified_base (398)..(398): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaccnggccaggcctcccgaggcctcctcatctatcgctgcatcccacgacgggccacgtggactcccagccaggttcagtgcaggtgggtctgggacagtagttcattcncaccatcagcagcctgcagtctagaagttntttgacttaatttattactgtacagtactaagttaattaaagtaacgttgggtacggtaaccggttcgggaaccgaaaggggtaaccttaaaggggtaattaaacgtacgaaaacgttaacgttggttggaacctggaacctacagttcctcgttccttaacg

SEQ ID NO: 442291 - DNA, 571 bp, Homo sapiens
  misc_feature: GZ8MTXP01CBQ9V.2.7.A07.1.454.CMB.2.raw
  modified_base (262)..(262): a, c, t, g, unknown or other
  modified_base (280)..(280): a, c, t, g, unknown or other
  modified_base (553)..(553): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaagacgcccaccctctcctgcagggccagtcagagtatagcagcaacttagcctggtaccagcagaaccnggccagctccagctcctnatctatgctgcactcccgaccgacgggcccacgtcggtactccccgagtccgtaggttcaggtcggactagggttggggtcctggggactaggtacgtttcatttccacacctatcacgcacgtcctgctagtctagtaagttatttagacttaatttacttacgtgtacagtactagttaactaagttacgtgggtacgtacgttcggacgaaagggtacaaagggtaacaagtaacgaacgttacgttgggttacgctcggaactaccgtnttccttcgttcctttccg

SEQ ID NO: 442292 - DNA, 736 bp, Homo sapiens
  misc_feature: GZ8MTXP01A204R.2.7.A07.1.454.CMB.2.raw
  modified_base (198)..(198): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcagggccagtcagagtatagcagcaacttagcctggtaccagcaagaaccnggaccaggcctcccaggcctcctcatctatgctgcactcccaccgacgggccctacgtcggtactccccgaagtccgtacgggtttcaggttcgggaccgtaggggttcggggtacgtgggggaaacctagggttacgtttccaagttttcccgacctaacccgtattccgaacggccgtaacggtccccgttaggacctaggttaccgtaaggtaaacgtttagtttttaacggaaccttttaaaagtttttacgtttaaccttagggttaacccaaggttaacctaaaggttaaacgtttaaacgttaaaccggtttggggtacggggttaacccggtttaccgggggaaacccgtaaaacgggggtaaacccttaaaggggtaaacgaaaaccgtaacgtaaaaaccggttacgttggttaccgggtctacggaacctaaccgtattccgttcgttcgtttaacccg

SEQ ID NO: 442293 - DNA, 637 bp, Homo sapiens
  misc_feature: GZ8MTXP01BIKA1.2.7.A07.1.454.CMB.2.raw
  modified_base (196)..(196): a, c, t, g, unknown or other
  modified_base (264)..(264): a, c, t, g, unknown or other
  modified_base (291)..(291): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagcaacttagcctggtaccagacaagaaccgnggaccaggcctcccgaggcctccctanactctatcgctgacctactaccccgacgacgggcccacgtcggtactcccgagtccgtaggttcgaggtcggcgtagggtcggggtcgtggggactagggtacgtttactacgttccacacctagtccgaagccacgtcccgtagtaccgtagttctaggtaaagttctttagactttaaatttacttacgttgtacctagtactaagtaagtaagttaacggtggttacggtacgttaccggaacggtaaagggtaacgttaaagggtaacgttaaacgtacgtaaacggttaacgttgggttacgtaacctggaacctaaccgtatttcgtcgttcctttaacg

SEQ ID NO: 442294 - DNA, 549 bp, Homo sapiens
  misc_feature: GZ8MTXP01B8NH8.2.7.A07.1.454.CMB.2.raw
  modified_base (197)..(197): a, c, t, g, unknown or other
  modified_base (263)..(263): a, c, t, g, unknown or other
  modified_base (285)..(285): a, c, t, g, unknown or other
  modified_base (405)..(405): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgccaccctctcctgcagggccagtcagagtattagcagcaacttagcctggtaccagcagaacnggcagctccagctctcatctangctgcactccacgacgggccacgtggtactcccagtccctaggttccaggtggcaggtcgggtctggggacaggtagtttcatttccacacatcagtcacgcctgactagtctagtaatntttgacttaattttatactgtacaagtctaagttataaagttaacgtgggtacggtacgttcggaacgtaaagggaaccaaagggtaaacaaagtaaccgaaagacgttggttagggctgaacctacgattcgtcgttcttccg

SEQ ID NO: 442295 - DNA, 613 bp, Homo sapiens
  misc_feature: GZ8MTXP01CU7UF.2.7.A07.1.454.CMB.2.raw
  modified_base (197)..(197): a, c, t, g, unknown or other
  modified_base (265)..(265): a, c, t, g, unknown or other
  modified_base (446)..(446): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtatagcagcaacttgcctggtaccagacaagaaaccnggccaggcctcccaggtcctcctcatcctatcgctgccactccaccgagggcccacgtcggtactcccgagtccgtacggttcgaggtcgacgtaggtcgggtacgtgggaacagggtacgtttctaacttcctaccgactatacacgacacggtccctagactacgttctagtaaagttntttagaactttaatttcgttaactgttacatacgtaagtaacttagttaacgtggtacggtaccggttacggaacggaaaggtaaccaagggtaaaccaagtaaaccgaaacgttaacgttcgggttacgcgttacgcctaacctgttaccgtcgttccgttaaccg

SEQ ID NO: 442296 - DNA, 565 bp, Homo sapiens
  misc_feature: GZ8MTXP01ACF84.2.7.A07.1.454.CMB.2.raw
  modified_base (197)..(197): a, c, t, g, unknown or other
  modified_base (262)..(262): a, c, t, g, unknown or other
  modified_base (284)..(284): a, c, t, g, unknown or other
  modified_base (372)..(372): a, c, t, g, unknown or other
  modified_base (377)..(377): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaccnggccaggctcccaggcctcctnatctatgctgcactcccaccgagggcccagtggtactcccagcctaggttcaggtggctaggtgggtctggggacagtagttcattcncaccntcagcagcctgcagtctagaagtatttagacttaatttattactgtacagtctaagtataagtaactgggtaggtacggttcggacgtaaagggaaccttaaagggtaacgttaaaacgtacgtaaaacgttaacgttgggttacgggtaactaggaacctacctacgttcttaacgttcttaacccg

SEQ ID NO: 442297 - DNA, 681 bp, Homo sapiens
  misc_feature: GZ8MTXP01AVZRY.2.7.A07.1.454.CMB.2.raw
  modified_base (198)..(198): a, c, t, g, unknown or other
  modified_base (263)..(263): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagctaacttgcctggtaccagcagaaccnggccaggcctccgaggcctcctcatctatgctgccactcccgaccgacgggccctacgtcggtactcccgagcccgtaggttcaggtcggacgtagggtcgggtcgtgggggactagggtacgtttctagtttcccacgtaaccctattacccgaacggcccgaacggtcccgtaggtacccgtaacggtttaccgtaaggtaaagtttacgttttacggaaacttttaaacgttttacttaacgttacggtttaaccaaggttaccgttaaagttaaacttaaagtttaaaccgggttggggttaccggggttaaccgttaccggggaaaccggtaaaggggaaccgttaaagggtaaacgaaacgtacgaaaacgttacgttggttacggctagccactagttctcgttcttaacg

SEQ ID NO: 442298 - DNA, 577 bp, Homo sapiens
  misc_feature: GZ8MTXP01AG3QT.2.7.A07.1.454.CMB.2.raw
  modified_base (198)..(198): a, c, t, g, unknown or other
  modified_base (289)..(289): a, c, t, g, unknown or other
  modified_base (323)..(323): a, c, t, g, unknown or other
  modified_base (409)..(409): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcagggccagtcagagtatagcagcaacttagcctggtaccagcagaacctggccaggcctcccgaggcctcctnatctatgctgcactccacgagggccacgtgtacnccgagcctaggtcagtgctaggtgggtctgggacagtacgttcattcacacatcgagcacgccttgaccgtagttctagtaagttnttttagactttaaatttagttactggtacagtactaagttaataagttaacgtgggtacggtacgttaccgggacgtaaacggggaaccttaaagggtaaacgaaacgtaccgaaaacggcgttggacggaactaggaacctaacctagttcctcgttccttaacccg

SEQ ID NO: 442299 - DNA, 571 bp, Homo sapiens
  misc_feature: GZ8MTXP01BSPN4.2.7.A07.1.454.CMB.2.raw
  modified_base (197)..(197): a, c, t, g, unknown or other
  modified_base (263)..(263): a, c, t, g, unknown or other
  modified_base (282)..(282): a, c, t, g, unknown or other
  modified_base (419)..(419): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaaccnggcaggctccaggctcctnatctatgctgcactcccaccgacgggcccacgtggtactccccgagccctaggttcaggtggcaggtgggtctggggacagggtacgttcatttcctacacccatccaggccacggccctgctagtctagtaagttntttgacttaatttagtacgtgtacagtctaagttactaagtacggttgggtcggtacgttcgggaccgaaagggtaacccttaaagggtacaaagtaccgaaaacggttacgttggacggaactacggccaacctagttcctgttaacctcc

SEQ ID NO: 442300 - DNA, 565 bp, Homo sapiens
  misc_feature: GZ8MTXP01BD8RG.2.7.A07.1.454.CMB.2.raw
  modified_base (197)..(197): a, c, t, g, unknown or other
  modified_base (261)..(261): a, c, t, g, unknown or other
  modified_base (377)..(377): a, c, t, g, unknown or other
  modified_base (546)..(546): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttgcctggtaccagcagaaccnggccaggctccaggcctcctcatctatcgctgcactccaccgagggcccacgtggtactcccgagcccgtaggttccagtggcctaggtgggtctggggacaggtacgttcattcncacctatcagcagcctgctagtcagtaagtatttagacttaatttagttacttgtacagtactaagttaattaaatacgttggtagggtacgttacgggacgtaaacggggacttaaagggtaagaaacgtacgaaacgaacgttcggttaggtaactagaacctaccnttaccgtcgttaacttccg

SEQ ID NO: 442301 - DNA, 552 bp, Homo sapiens
  misc_feature: GZ8MTXP01A69W0.2.7.A07.1.454.CMB.2.raw
  modified_base (196)..(196): a, c, t, g, unknown or other
  modified_base (285)..(285): a, c, t, g, unknown or other
  modified_base (304)..(304): a, c, t, g, unknown or other
  modified_base (402)..(402): a, c, t, g, unknown or other
  modified_base (414)..(414): a, c, t, g, unknown or other
  modified_base (539)..(539): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanacgccaccctctcctgcagggccagtcagagtattagcagcaacttagcctggtaccagcagaaacctggccaggctcccaggctcctnatctatgctgcatcccacngggcccagtggtactccccagcccgtaggttcaggtggctaggtcgggtctggggacagggtacttcatttccacacctatcagcagcctgccagttntaggtaaatttnttatactttaatttacgtacgtgtacagtataagtaataagtacgtggtacggtacgtacgaacggaaggtaacgaaggtaacaaacgtaacgaacgttacgttggttacgaactacgcctactnttcttcgttctcg

SEQ ID NO: 442302 - DNA, 628 bp, Homo sapiens
  misc_feature: GZ8MTXP01CX1CL.2.7.A07.1.454.CMB.2.raw
  modified_base (197)..(197): a, c, t, g, unknown or other
  modified_base (293)..(293): a, c, t, g, unknown or other
  modified_base (611)..(611): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgccaccctctcctgcagggccagtcagagtatagcagcaacttagcctggtaccagacaagaaacctggaccaggcctcccgaggtcctccctnatcctatcgctcgctaactcccgaaccgacgggcccacgttaggtacctccccgagtcccgtaaggttcaaggttggaccgtagggttcgggggtactgggggacctagggtacgtttcatttccacaacctatcgaagcaggcccttggctacgttcgtaaggtaagttacttttgaactttaaagttttatttaacgtggttaccaggtactaagttaattaacgttaaggtggtacgggtaccgttacgggacgtaaagggtaccgaaagggtacaaagtacgaaacggttacgttggttacgctagctaccgtnttcgttgttcctttaac

SEQ ID NO: 442303 - DNA, 635 bp, Homo sapiens
  misc_feature: GZ8MTXP01BWX56.2.7.A07.1.454.CMB.2.raw
  modified_base (197)..(197): a, c, t, g, unknown or other
  modified_base (493)..(493): a, c, t, g, unknown or other
  modified_base (571)..(571): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagctaacttagcctggtaccagacaagaaacctggaccacgggcctacccgaggccctcctctatctatcgactgacctactcccgaaccgacgggccctacggtcggtactccccgagtcccgtaagggtttccaggtcgggctagggttcggggtactgggggaactagggtacgttctaagtttccacaaccctagtccaggccgacgtcccttagaccgtagttcaggtaaagttactttagactttaaagttttntacgttgtacagtactaagtaataagtacgttggtacggtacgttacgggacctaaaggggaaccttaaagggtaaanaaacgtacgaaaacggttacgttggttacgaactcgaactacctattcgtaacgtttccgtaac

SEQ ID NO: 442304 - DNA, 589 bp, Homo sapiens
  misc_feature: GZ8MTXP01EJ0B9.2.7.A07.1.454.CMB.2.raw
  modified_base (198)..(198): a, c, t, g, unknown or other
  modified_base (264)..(264): a, c, t, g, unknown or other
  modified_base (283)..(283): a, c, t, g, unknown or other
  modified_base (298)..(298): a, c, t, g, unknown or other
  modified_base (302)..(302): a, c, t, g, unknown or other
  modified_base (393)..(393): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcaaacgnaaccagcacgcgccacgcncctcatctactgctncacnccgacccacggcgactcgtacgtcccacgtcccaggtcgacgtggtcggtacgtggggtcgtgggacgtacgagttctactctctcatcangccacgcctagtctagtacgtagttaagtacttacgttacttaactttagttactacgtactagtacgtaacgttaactaagttaacgttacggttacgggttaccggtaaccgggtaaccggaacgggttaacggttaaacggtaaacgtaaacgtaaacgtaaacgtaacgttacgtaacggttaacgtaaccg

SEQ ID NO: 442305 - DNA, 657 bp, Homo sapiens
  misc_feature: GZ8MTXP01APJO6.2.7.A07.1.454.CMB.2.raw
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttagcctggtacccagacaagaaaccctggcccaggcctccccgaggcctcctcatctatgctgcactcccaccgagggccctacgtggtactccccgagcctaggttcaggtggcgtagggtcggggttctggggaacctagggtacgtttcctaatttccncaacctactcacgcacgccttgactagtctagtaagttattttgacttaaattttacgttaacttggtactaaggactagtaaattaaacgttaacggttgggtacgggttaaccggttccgggaacccggtaaacgggggaaaccttaaaggggtaaacgttaaaacgttaaaccggaaaaaccggttaaccgttggggttacggccgtaaggtaacccaacccgttagttccctttaacggttccttttcccg

SEQ ID NO: 442306 - DNA, 669 bp, Homo sapiens
  misc_feature: GZ8MTXP01EC6Q3.2.7.A07.1.454.CMB.2.raw
  modified_base (197)..(197): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaactgcctggtaccagcaacgaaaccnggaccaggcctacccaggcctcctcatctatcgctgccactcccaccgacgggccctacgtcggtacctcccgacgtccgtacggttccagggtcggcgtagggtcggggtacgtgggggaactagggtacgttacctagtttccgacaaccctatcgaacgtcgacgtccgtgtaccgtagttactaggtaagttattttagtaactttaattttacgttacttacgttacgtagtacttaagttaaacttaaagttaaaccgggttgggttacgggtaaccggtttaccgggaacccggtaaaagggtaacccgttaaagggttaaacgaaaacgtaacgtaaaacgttaacgttcggttacggtcgtcgaacctaccgtattccgttcgttccgtttaacccg

SEQ ID NO: 442307 - DNA, 800 bp, Homo sapiens
  misc_feature: GZ8MTXP01EM7SA.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcgagggccagtcagagtattagcagctaacttgccgtaggtacccagcaacgaaaccgtggaccagggcctacccgaggccttcctacatctatcgctagcactcccgacgacgggccctacgtcggtacctcccgagtccgtaggttccgaggttcgggcgtaggggttcggggtacccgttaagggggaacctaaggggttacgtttaccgtaacgttttccccgacgtaaaccctacttccgaaacgggtcccaacggggtccccctttagggacccttaacgggtttaccgtaaaggggttaaaacgtttaccttttttaggaaaccctttttaaagttttttaacgtttaacccgtttacggggtttaacccaaagggttaaccttaaaaggtttaaacgtttaaaacggttaaaccggggtttggggtaaaccgggttaccgggtttaacccggggaaaccgtaaaacgggggtaaacccgttaaagggttaaaacgttaaaacgtaaacccgtaaaaacggacgttgggttaacggccttaggaacccgtacctaggttcttaaccgtttcctaacccg

SEQ ID NO: 442308 - DNA, 727 bp, Homo sapiens
  misc_feature: GZ8MTXP01CPKC2.2.7.A07.1.454.CMB.2.raw
  modified_base (200)..(200): a, c, t, g, unknown or other
  modified_base (273)..(273): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccatggagaagtggtgatgacgcagtcctccagcccaccctgtctgtgtctaccggaaggggaaancgcccaccctctcctgcgacgggccagtcaaggtagtatagcagactaactgcctggtaccagacaagaaccnggaccaggcctcccgagtcctcctacatctagtcgctcgacactcccgacgtacgggcccagttcgtacctcccgagccgtaggttcgaggtggacgtagggttcgggtactgggaactagggttacgtttaccagtttccaccaacccgtagtccgacgaccgacggtcctaggacttacggtacttaaggtaaactttagtttaccgtaaacttttaaatttttacgggttaaccgttaggttaccaacgggttaaacttaaaggtttaaaattaaccggttaaccgggttaggggttaaccgggtacccggtttaaccggggaaacccgtaaaagggggttaaacccaaaagggggtttaaaccaaaacgttaaaccggaaaaccgtttggttcggacgggttaaccacggtaaccctaacgttcgttctttaaccgttaactttaacccg

SEQ ID NO: 442309 - DNA, 526 bp, Homo sapiens
  misc_feature: GZ8MTXP01CG8NN.2.7.A07.1.454.CMB.2.raw
  modified_base (197)..(197): a, c, t, g, unknown or other
  modified_base (263)..(263): a, c, t, g, unknown or other
  modified_base (362)..(362): a, c, t, g, unknown or other
  modified_base (377)..(377): a, c, t, g, unknown or other
  modified_base (379)..(379): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccacctctcctgcagggccagtcagagtattagcagcaacttagcctggtaccagcagaaaccnggccaggctcccaggctcctcatctatgctgcatcccacagggccactggtactcccagccaggttcagtggcagtgggtctgggacagagttcattcncaccatcagcagccngnagtctagagtattagtataatttaattatatacagatataataataagtagtaggtacgtacggacgaaacggaacgaaaggtaaagaaagtaaacgaaacgaaacgttagttaggtaacgtacgaacactacttactcgttcgttc

SEQ ID NO: 442310 - DNA, 538 bp, Homo sapiens
  misc_feature: GZ8MTXP01EB4S4.2.7.A07.1.454.CMB.2.raw
  modified_base (198)..(198): a, c, t, g, unknown or other
  modified_base (289)..(289): a, c, t, g, unknown or other
  modified_base (401)..(401): a, c, t, g, unknown or other
  modified_base (480)..(480): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctaggtaccagcaagaaacctggaccaggctcccgaggctccncatctatgctgcatcccacgagggcccagtggtactcccgagcctaggttcagtgcaggtgggtctggggacagtagttcagttcacacatcagcagcctgcagtctgaagnttttgattaatttatactgttacagtctaagtataagtaactgggtagacgttcggacgaaagggccttaaagggtaanaaactacgaaaacgttagttggttggaatgaactaccattccgtaagttctttaaccg

SEQ ID NO: 442311 - DNA, 587 bp, Homo sapiens
  misc_feature: GZ8MTXP01AB6ER.2.7.A07.1.454.CMB.2.raw
  modified_base (199)..(199): a, c, t, g, unknown or other
  modified_base (210)..(210): a, c, t, g, unknown or other
  modified_base (374)..(374): a, c, t, g, unknown or other
  modified_base (390)..(390): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctccgaaggggaaancgcccaccctntcctgcagggccagtcagagtattagcagcaacttgcctggtaccagacagaacctggccaggcctcccaggctcctcatcctatcgctgcactcccgaccagggcccaacgtggtactcccgagcctacgggttcaggttggcctaggtcggggtctgggganagggtagttcatttcncacctatcagcacgccttggacctagtcgtagaagttatttgaacttaatttacggttactaggtacctaaggtactaagtactaaagtacgtgggtacggtaccgttacggacgtaaagggaccaaaggggtacaaagttacgaaaacgttacgttggttagaaccgtagaaccacgtacttcgtcgttcttaacc

SEQ ID NO: 442312 - DNA, 531 bp, Homo sapiens
  misc_feature: GZ8MTXP01CSZ9E.2.7.A07.1.454.CMB.2.raw
  modified_base (196)..(196): a, c, t, g, unknown or other
  modified_base (253)..(253): a, c, t, g, unknown or other
  modified_base (267)..(267): a, c, t, g, unknown or other
  modified_base (273)..(273): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctccgaaggggaaancgccacctctctgcagggccagtcagagtatagcagcaattgctggacagcagaacngcagctccagctcnatctangctgcactccacgacgggccaacgtgtactcccgagccgtaggttcaggtggcgtaggtgggtctggggacaggtacgttcattcacaccatcaagcagcctagactagttcaggtaattatttgaacttaattttctactgtacagtctaaagtataagtaacgtgggtacgtacggttcgaccgaaagggacaaagggtaacaaacgtaacgaaacgttacgttggacggtcacgcacgtattcttcgttcttaac

SEQ ID NO: 442313 - DNA, 663 bp, Homo sapiens
  misc_feature: GZ8MTXP01ELCWP.2.7.A07.1.454.CMB.2.raw
  modified_base (197)..(197): a, c, t, g, unknown or other
  modified_base (291)..(291): a, c, t, g, unknown or other
  modified_base (492)..(492): a, c, t, g, unknown or other
  modified_base (619)..(619): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttgcctggtaccagacaagaaacctggccagggcctcccgaggcctcctnatctatcgctgctactcccgaaccgacggggccctaacgttgggttaacctcccccgaaggtccccgtaaggggttttaccaggggttcgggcctaaggggtttacggggtcctggggggaacctaagggtacgtttcaagtttccataattccaattcgaaggtcacggtcccttaggacctaagtcgtaaggtaaattnttttaggactttaaattttacgttacgttagttaccaagtactaagttaattaaacgtacgttgggtacggtaccggttcggaaccgtaaagggacctaaagggttacaaaattcgaaaaacggttnttagggtaaggacttaacggaccaacttagttccttaagttccc

SEQ ID NO: 442314 - DNA, 574 bp, Homo sapiens
  misc_feature: GZ8MTXP01AM8MU.2.7.A07.1.454.CMB.2.raw
  modified_base (199)..(199): a, c, t, g, unknown or other
  modified_base (269)..(269): a, c, t, g, unknown or other
  modified_base (329)..(329): a, c, t, g, unknown or other
  modified_base (433)..(433): a, c, t, g, unknown or other
  modified_base (542)..(542): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcgagggccagtcagagtattagcagcaacttagcctggtaccagcaagaaccnggccaggctcccgaggcctcctcatctatcgctgccatcccacgagggccacgtggtacnccagcctaggttcagtggctaggtgggtctgggacaggtagttcagttcctacgaccctatcagcacgcctgacaggtctaggaacgttatttgacttaatttntactgtcagtctaagtactaagtaacgtgggtacggacgttcgggacctaaagggggaaccttaaaggggtaaacaaacgtaccgaaaaacggttagttggacgggtcncggtaaccacctattcccttgttccttaaccg

SEQ ID NO: 442315 - DNA, 562 bp, Homo sapiens
  misc_feature: GZ8MTXP01BR6VU.2.7.A07.1.454.CMB.2.raw
  modified_base (195)..(195): a, c, t, g, unknown or other
  modified_base (258)..(258): a, c, t, g, unknown or other
  modified_base (276)..(276): a, c, t, g, unknown or other
  modified_base (282)..(282): a, c, t, g, unknown or other
  modified_base (296)..(296): a, c, t, g, unknown or other
  modified_base (337)..(337): a, c, t, g, unknown or other
  modified_base (344)..(344): a, c, t, g, unknown or other
  modified_base (380)..(380): a, c, t, g, unknown or other
  modified_base (513)..(513): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccaggggaaancgccaccctctcctgcagggccagtcagatatagcagcaacttgcctggtaccagcagaaccngccagctccaggctcctnatctangctgcatccaccgngggcccagtgtactccgagcctaggtcagtgcaggtgggtntgggacnggtagttcattctacacctatccagtcacgtccttnacgtctagtaacgtatttcgacttaattttattaacgtgtactagactaagtaataatacgtggtacgtacgttacggaccgaaagggtaaccgtaaaggttaagtaaacaacgtaaaaccgaagtttcgggngttaccgttaagaccaaccttaagtccgttacgttaaccttcgtaaccc

SEQ ID NO: 442316 - DNA, 543 bp, Homo sapiens
  misc_feature: GZ8MTXP01C8I2O.2.7.A07.1.454.CMB.2.raw
  modified_base (199)..(199): a, c, t, g, unknown or other
  modified_base (263)..(263): a, c, t, g, unknown or other
  modified_base (283)..(283): a, c, t, g, unknown or other
  modified_base (407)..(407): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaancgcccaccctctcctgcagggccagtcagagtatagcagcaacttgcctggaccagcagaaccnggccaggctccaggctcctnatctatgctgcactcccaccgagggcccacgtggtaactcccgagcctacggttcaggtggcgaggtgggtctgggacaggtagttcattctacaccatcagcagcctgactagtctagaattntttgacttaattttatctgtactagactaagttaataaagtaacgtgggtacgaccgttacggacgaaagggtaacaaagggtaacaaagtacgaaaagacgttggacggtctagctacagttctcgttcttaacc

SEQ ID NO: 442317 - DNA, 575 bp, Homo sapiens
  misc_feature: GZ8MTXP01BAUXR.2.7.A07.1.454.CMB.2.raw
  modified_base (197)..(197): a, c, t, g, unknown or other
  modified_base (260)..(260): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaattagcctggtaccagcagaacnggccaggctccaggctcctcatctatgctgcactcccaccgagggccctaacgtcggtaactccccgagccctaagggttcagggtggctaggtcggggtctggggacagggtacgttcatttcacaccatcagcagcctgacagtctagtaagtatttgactttaatttcgttactgttacgagtctaagtataaagttacgtgggtacgtacgttcggaccgaaagggtaccttaaggggtacaaagtaccgaaacggttacgttgggttacgcttcggaacctaacccgtcgttaccttcgtttccctaacg

SEQ ID NO: 442318 - DNA, 686 bp, Homo sapiens
  misc_feature: GZ8MTXP01BUZKD.2.7.A07.1.454.CMB.2.raw
  modified_base (197)..(197): a, c, t, g, unknown or other
  modified_base (263)..(263): a, c, t, g, unknown or other
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaaccnggccaggcctcccgaggcctcctnatctatcgctgccactcccgaccgacgggccctacgtcggtactccccgaggtcccgtaggttccaggtcggcgtagggtcggggtcgtgggggactagggtacgtttcacgttttccacctaacctagttccgaacggtccaacggtcccgttaggacccgttaggttccgtaaggtaaacgtttagtttttacggaactttaaagtttttactttacgttaggttaccaaggtaccttaaaggttaacttaaacgttaaccggttggggtacggttaccggttaccgggaacccggtaaaggggtaaccgttaaaggggtaaacaaacgttaaccgaaaacggttacgttgggttacgccgttcgaacctacccgtagttccttcgttccttaaccg

SEQ ID NO: 442319 - DNA, 526 bp, Homo sapiens
  misc_feature: GZ8MTXP01DMBTT.2.7.A07.1.454.CMB.2.raw
  modified_base (197)..(197): a, c, t, g, unknown or other
  modified_base (362)..(362): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggctcccaggctcctcatctatgctgcatccacagggccatggtatcccagccaggttcagtggcagtgggtctggggacaggagttcattcncaccatcagcagcctgcagtctgaagtattttgactaatttagttacttgtcagtctaagtataataacgtggtggacgttcggacaaagggaccaaagggttagaaaatacgaaaacgaacgttggttacggtctacggcaacctattccgtgttctttaacg

SEQ ID NO: 442320 - DNA, 714 bp, Homo sapiens
  misc_feature: GZ8MTXP01BNM19.2.7.A07.1.454.CMB.2.raw
  modified_base (196)..(196): a, c, t, g, unknown or other
  modified_base (267)..(267): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccatggagaagtggtgatgacgcagtctccagccacctgtctgtgtctccgaaggggaaancgccaccctctcctgcagggccagtcagtagtattagcagcaacttagcctggtaccagacaagaaaccgnggaccacggcctcccgaggtcctcctacacttctatcgctcgaccactccccgaccgacgggccctacggtcggttaacctccccgaaggtcccgtaacggggtttccgaagggttcggggcctaagggggttccggggttaccgtaagggggaacctagggtacggtttacctacgtttacccgaccaaaccccgtatcccgaggaccacggtcccctagggccctaaggttacgtaggtaaagttatttttacggaaactttaaattttacgttaaccgtgttaccaaggtctaaagtttaactaaacgttaacggtgggtacgggttacggttccggaaacggaaacgggtaaccttaaagggtaacaaaacgttaaaccgaaacggttaacgttgggttacgtaaccgtagaaccctaacgtatttacgtcgttccgttaacc

SEQ ID NO: 442321 - DNA, 559 bp, Homo sapiens
  misc_feature: GZ8MTXP01ASX2K.2.7.A07.1.454.CMB.2.raw
  modified_base (197)..(197): a, c, t, g, unknown or other
  modified_base (261)..(261): a, c, t, g, unknown or other
  modified_base (369)..(369): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggaccagcagaaccnggccaggctcccgaggctcctcatctatgctgcatccacgagggcccactggtactcccagcctaggttcaggtggcaggtcgggtctggggacagtagttcatttcncaccatcagcagcctgacagtctagtaagttatttgacttaatttattactgtacagtactagttaataagtaacgttgggtacggtacgttccgggaaccgtaaggggtaaccaaagggtaacaaacgtaaccgaaaagttacgttggttcggtaactacggaacctaactacttcctcgttccttaac

SEQ ID NO: 442322 - DNA, 621 bp, Homo sapiens
  misc_feature: GZ8MTXP01C83YR.2.7.A07.1.454.CMB.2.raw
  modified_base (196)..(196): a, c, t, g, unknown or other
  modified_base (264)..(264): a, c, t, g, unknown or other
  modified_base (287)..(287): a, c, t, g, unknown or other
  modified_base (554)..(554): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttagcctggtaccagcaagaaaccnggccaggcctcccaggcctcctnatctatcgctcgcactcccaccgacgggacccacgttcggtaacctccccgagtccccgtagggtttccaggttcggcgtagggttggggtcgttgggggaacctagggtacgtttcaactttcctacaccctatccgaaggcccaacggcccttaggactaggttcgtaaggtaagttattttagactttaaattttacgttactgtacagtactaagtataagtaacgtgggtagtacgttcggacgaaagggacaaagggtaanaaactacgaaacgttaacgttggttacggaactacgaacctactacttacttcgttccgtttaaccg

SEQ ID NO: 442323 - DNA, 570 bp, Homo sapiens
  misc_feature: GZ8MTXP01CNN1C.2.7.A07.1.454.CMB.2.raw
  modified_base (298)..(298): a, c, t, g, unknown or other
  modified_base (422)..(422): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctctcagatgccactggagaagtggtgatgacgcagtctccagccaccctgtctgtgtctccgaggggaaagcgccaccctctcctgcagggccagtcagagtatagcagctaacttagcctggtaccagacaacgaacctggccaggcctcccgaggtcctcctcatctancgctgcactcccaccgaggccagtcggactcccgagcccctaggttcaggtgcgtaagggtgggtcgtgggacaggtacgttcacttcaccaccatcagcacgccgtgctagtcgtagaagttntttgaacttaatttcttactgtacagtactagtaataaagtacgtgggtacgtacggtcggaacgtaaacgggaaccgtaaagggttaaacgaaacgtacgaaaaggcgttggtaacggacttcgactacgttattcgttgtttaacc

SEQ ID NO: 442324 - DNA, 784 bp, Homo sapiens
  misc_feature: GZ8MTXP01CIYLA.2.7.A07.1.454.CMB.2.raw
  modified_base (197)..(197): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcagaaccnggaccaggcctcccgaggcctcctcatctatgctcgcctactcccaccgacgggcccacgtcggtactcccagccgtacggttcaggtcggctagggttggggtctgggggactaagggtcgtttacacgtttacctaccgaaaccctagtaccgacggaccgacggtccccttaggaccgttaacggttaccgttaagggtaaacggtttacgttttttacgggtaaaccttttaaaagtttttttaacgtttaaccgttttacggttaaccgttaaacggtacccgttaaaaggtttaaactttaaaacggtttaaaccggtttacgggggttaaccggggttaaacccgggtttacccggggaaacccggtaaaacgggggtaaacccgttaaaagggggttaaaacgttaaaacggttaaaaccggaaaacccgggttaaacgttcgggttaacgggtaaccgttacggtaaccctaaccgttacgttcccgttaacggtttccccgtttaacccg

SEQ ID NO: 442325 - DNA, 616 bp, Homo sapiens
  misc_feature: GZ8MTXP01ELDUF.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggcctacccgaggcctcctcatctatcgctgcactccaccgaggggccctagtggtactcccgagccctaggttcaggtggcaggtgggctggggactaggagttcattccacaccatcagcacgcctggacctagttcagaagttatttagacttaaagttttacttacgttgtaccagtactaagttaacttaaagtacgttgggtacggtaccggtttcgggaaccgtaaaggggtaacccttaaaggggtaaacgaaaacgtaaccgtaaaaacggttaccgttgggttacgggtccttacgggccctaaaccgtagttaccgtttcgttaactttaacccg

SEQ ID NO: 442326 - DNA, 304 bp, Homo sapiens
  misc_feature: GZ8MTXP01EZ5XS.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggaagagccaccctctcctgcaggccagtcagagtattagcagcaacttacgtaccgtacggtaccgacgacgaacgaaccgtacggaccgacggaccgtacccgacgcctcccc

SEQ ID NO: 442327 - DNA, 647 bp, Homo sapiens
  misc_feature: GZ8MTXP01AJJEY.2.7.A07.1.454.CMB.2.raw
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaaccnggccaggctcccgaggcctcctcatctatgctgcactcccaccgagggccctacgtggtactcccgagtccgtagggtttccaggtcgggacgtagggttcgggggtaccgtggggacctagggtacgtttcatttcctaccacctatcaggcacgccttgactagttctaggtaaagttcttttagactttaaatttacgttacttgtacaagtactaagttaacttaaagttaaacggttggggtacggtaccggtttacgggaaccggtaaaggggtaacccttaaaggggttaaacgaaacgttaaccgaaaaacggttacgttggttacgggtaaccttgggaacctacccgtattaccgttcgtttcctttaacccg

SEQ ID NO: 442328 - DNA, 683 bp, Homo sapiens
  misc_feature: GZ8MTXP01BYH0T.2.7.A07.1.454.CMB.2.raw
  modified_base (197)..(197): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaccnggccaggctcccaggcctcctcatctatgctgcactcccaccgacgggccctaacgtcggtactcccccgaggtccctaagggtttccaggttgggccagggttcgggggtcctggggggacctaaggggtacgtttccaattttccgtacaacccctattccgaacggccacggtccccttggacctaggttcctaggtaaagttactttttaggacctttaaatttttactttacgttggttaccaggtactaaagttaacttaaagttaaacggttggggtacgggtaccggtttaccgggaccggtaaacgggggtaaccttaaaggggtaaacgaaacgttaaccgaaaacgttaaccggttgggttacgggtcttacggcctaaccgtacgttccttaacggtttccctttaaccg

SEQ ID NO: 442329 - DNA, 628 bp, Homo sapiens
  misc_feature: GZ8MTXP01A8F6N.2.7.A07.1.454.CMB.2.raw
  modified_base (197)..(197): a, c, t, g, unknown or other
  modified_base (263)..(263): a, c, t, g, unknown or other
  modified_base (286)..(286): a, c, t, g, unknown or other
  modified_base (323)..(323): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcaagaaccnggccaggcctccgaggcctcctnatctatgctgccactcccaccgagggcctagtgtacnccagcctaggttcagtggctaggtgggtctggggactaggtacgtttcagtttcccacaaccgtataccgaaggccaacggtccctaggtacccgtaaggttcgtaaagggtaaacgttatttttacggaacttttaaagttttacggtttacgttggtacctaaggtactaaggtttaacttaaagttaacgttgggtacggtaccggttacgggaaccgtaaaggggaaccttaaaggggttaacaaaacgtacgaaaacgttacgttggacggtctagaacctactattcttgttccttaac

SEQ ID NO: 442330 - DNA, 590 bp, Homo sapiens
  misc_feature: GZ8MTXP01BE3T4.2.7.A07.1.454.CMB.2.raw
  modified_base (196)..(196): a, c, t, g, unknown or other
  modified_base (260)..(260): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttgcctggtaccagcagaaaccnggccaggctcccaggcctcctcatctatgctgcatcccacagggcctacgtggtactcccgagccctaggttcaggtggctaggtggggtcctggggactaaggtcgtttacactttccacactacgtcaacggcacggtcctggacagttctagaagttcttttagcttaaatttgttactgtacaggtctaagttaataaacgtaaacgttggggtacgggtaacgttcggggacctaaaggggaaccttaaaggggtaacaaacgtacgaaaaccgttgttagttcgggaactcggccaaccgtattccgttaacgttctttaaccc

SEQ ID NO: 442331 - DNA, 676 bp, Homo sapiens
  misc_feature: GZ8MTXP01BU8FY.2.7.A07.1.454.CMB.2.raw
  modified_base (196)..(196): a, c, t, g, unknown or other
  modified_base (251)..(251): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatgcagcaacttgctggacagcanaacngcagcnccagctctnatctatgctgcactcccacgacgggcctacgtcggtaactcccgagcctacggttcaggtcggacgtaggttcgggtcgtggggactagggtacgtttccatttccacaaccctattcgaacgccgaacgtcccgtaggacctaacgggttctaaggtaaacgttatttttacggaaccttttaaacgttttaagtttaaactttcgggttaaccaaaggttaccttaaacgggtttaaattaaaaccggtttaaacggttgggggtttaaccggttaaccggtttaaccggggaacccggaaaaggggtaaacccgttaaagggtaaaacgttaaactaacgtaaaacgttaacgttggttacgtaacgtcgaaccctacgtacttccttaacgttaacctttcg

SEQ ID NO: 442332 - DNA, 511 bp, Homo sapiens
  misc_feature: GZ8MTXP01E03P6.2.7.A07.1.454.CMB.2.raw
  modified_base (197)..(197): a, c, t, g, unknown or other
  modified_base (264)..(264): a, c, t, g, unknown or other
  modified_base (285)..(285): a, c, t, g, unknown or other
  modified_base (317)..(317): a, c, t, g, unknown or other
  modified_base (363)..(363): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcaagaaaccnggccaggctcccaggctcctnatctatgctgcatccaccagggccactggtancccagccaggttcagtggcaggtgggtctgggacagagttcattcncaccatcagcagcctgcagtctagaagtatttgactaaattttatactgtcagcaagttataaataaactgggtagacgttcggccgaaagggaaccaaaggtagaaaatacaaaacgaacgttgaggtcagcacattcttgttcttc

SEQ ID NO: 442333 - DNA, 552 bp, Homo sapiens
  misc_feature: GZ8MTXP01EQ9T8.2.7.A07.1.454.CMB.2.raw
  modified_base (196)..(196): a, c, t, g, unknown or other
  modified_base (262)..(262): a, c, t, g, unknown or other
  modified_base (366)..(366): a, c, t, g, unknown or other
  modified_base (375)..(375): a, c, t, g, unknown or other
  modified_base (534)..(534): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaaccnggcaggctcccaggcctcctcatctatgctgcactcccaccgagggcccactggtactcccagccaggttcagtggcagtgggtctggggacagagttcattcncaccatcancagcctgcagttctagtaaagtacttttagacttaaattttattaacgttgtaccagtcaagttattaaagtaacgtggtaggacgtttcgggaccgaaagggtaaccaaagggtaagaaagtacgaaaacgttaacgttggttacggctgctaacccngttactcgtttcttaacg

SEQ ID NO: 442334 - DNA, 657 bp, Homo sapiens
  misc_feature: GZ8MTXP01DGSL8.2.7.A07.1.454.CMB.2.raw
  modified_base (267)..(267): a, c, t, g, unknown or other
  modified_base (438)..(438): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgcccaccctctcctgcagggccagtcagagtatagcagcaacttgcctggtaccagacaagaaaccnggaccaggcctccgaggcctcctcatctatcgctgacactcccacgacgggcccacgttggtacctcccgagtcccgtaggttcaggtcggctaggtggggtctggggaactagggtacgttcattctacacctatcgagcacgtcctagactagttctaaggtaaagttntttagaactttaaattttacttacgttagtacgtaagtactaaagttaaacttaaagtttaaacggtgggttaacggtaaccggttaccgggaaaccggtaaaaggggtaaccgttaaaaggggttaaacgaaaaacgttaaccgtaaaaaccggttagttgggttacggtaacgttaacgaacctaacccgtagtttccttaacggtttcctttaacg

SEQ ID NO: 442335 - DNA, 726 bp, Homo sapiens
  misc_feature: GZ8MTXP01AG53E.2.7.A07.1.454.CMB.2.raw
  modified_base (195)..(195): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaancgccaccctctcctgcagggccagtcagagtatagcagcaacttacgcctggtaccagcagaaaccnggaccaggcctacccgaggcctccgtcatctatcgctgccactacccgaccgagggccctacgttcggtacctccccgacggtcccgtaacgggttccagggtgggaccgtagggttcgggggtaccgttgggggacctaagggttacgtttacctaacgttttcccacctaaccctagtaccgaacggtccgaacggtcccttaggacgtacggttcgtaagggtaaagttacttttaggtaacctttaaattttacgttaacgttcggtactaacgtacgtaaagttaacgttaaacgttaaccgggttagggtaccgggtaaccggttaaccgggaccggtaaaacgggggtaacccgttaaaggggtaaacgaaaacgtaaccgtaaaaaccgggttacgttcgggttacgggtcctaggaaccctaacggttacttcccgtcgtttaaccgtttaaccc

SEQ ID NO: 442336 - DNA, 583 bp, Homo sapiens
  misc_feature: GZ8MTXP01AXISF.2.7.A07.1.454.CMB.2.raw
  modified_base (197)..(197): a, c, t, g, unknown or other
  modified_base (266)..(266): a, c, t, g, unknown or other
  modified_base (287)..(287): a, c, t, g, unknown or other
  modified_base (321)..(321): a, c, t, g, unknown or other
  modified_base (367)..(367): a, c, t, g, unknown or other
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtattagcagcaacttagcctggtaccagcaagaaaccnggccaggcctccaggctcctnatctatgctgcatcccacagggccacgtggtacncccagccaggttcaggtgcaggtgggtctgggactagattcattcncaccatcagcacgcctgctagtctagaagttnttttgacttaattttattactgtacagtactaagttaattaagtaacgttgggtacggtaacgtttacgggaccgtaaaggggtaacccaaaggggttaaacgaaaacgtaaccgaaaaaccggttacgttggttacgggtaacctaggtaaccaacccgtattccggttcgttcctttaaccg

SEQ ID NO: 442337 - DNA, 667 bp, Homo sapiens
  misc_feature: GZ8MTXP01CPC5H.2.7.A07.1.454.CMB.2.raw
  modified_base (197)..(197): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgcctactctggctcccagatgccactggagaagtggtgatgacgcagtctccagccaccctgtctgtgtctccgagggaaanacgcccaccctctctgcagggccagtcagagtatagcagcaacttagcctaggtaccagcaagaaccgnggccaggcctcccgaggcctcctcatctatcgctgccactcccaccgacgggcccacgtacggtactcccgagtcccgtaggttccaggtcggcgagggttcggggtctgggggactagggtacgtttacacgtttcctacgacccattcgaacggtccaacggtccctggactacggttcgtaaggtaagttacttttagaactttaaagttttacgttacgttacgttacagtacttaagttaattaaacgttacggttacgggttacggtaaccggtttaccgggaaccgtaaacggggtaaaccgttaaagggtaaacgttaaacgtaaaccgaaacggttacgttggttcgggtaactcggtaacctaacgtagttccgttcgttaaccgttaacc

SEQ ID NO: 442338 - DNA, 584 bp, Homo sapiens
  misc_feature: GZ8MTXP01EYZJY.2.7.A07.1.454.CMB.2.raw
  modified_base (197)..(197): a, c, t, g, unknown or other
  modified_base (262)..(262): a, c, t, g, unknown or other
  modified_base (280)..(280): a, c, t, g, unknown or other
  modified_base (424)..(424): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaccnggcagctccgagctcctnatctatgctgcactcccacgacgggcctacgtggtactcccgagcctaggttccaggtcggctaggtgggtctggggactagggtacgttctaagtttccacaccctatccagccagccttgacctaggttctaggtaaagttnttttagaactttaaagttttacgttacttgtacagtactaattaataagtaaccgtgggtacggtacgttcggaaccgtaagggaaccttaaagggtaagaaactacgaaaacgttacgttggcggaactagaacctacgtattcgtaagtttccttaac

SEQ ID NO: 442339 - DNA, 635 bp, Homo sapiens
  misc_feature: GZ8MTXP01CR8DF.2.7.A07.1.454.CMB.2.raw
  modified_base (196)..(196): a, c, t, g, unknown or other
  modified_base (266)..(266): a, c, t, g, unknown or other
  modified_base (580)..(580): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcgagggccagtcagagtatagcagctaacttgcctggtaccagacagaaacccgnggacccaggcctacccgaggcctccctcatctatgctgccactcccgaccgacgggcccaacgttggtacctccccgagtcccgtagggtttccaaggttcggaccgtagggtcggggtcgtgggggaacctagggtacgttctaacttccctacaaacccgtatacgaaacggccaacggtccccttaggaccttaaggttctaaggtaaagttattttacggactttaaattttagttaccgttggtaccaggtactaaggtaattaagtacgtgggtgtacggttcggacgaaagggtaccaagggttaanaagttaaccgaagttaacgttgacggtctagcctactagttcttgttccttaacc

SEQ ID NO: 442340 - DNA, 513 bp, Homo sapiens
  misc_feature: GZ8MTXP01CW5IE.2.7.A07.1.454.CMB.2.raw
  modified_base (197)..(197): a, c, t, g, unknown or other
  modified_base (265)..(265): a, c, t, g, unknown or other
  modified_base (275)..(275): a, c, t, g, unknown or other
  modified_base (289)..(289): a, c, t, g, unknown or other
  modified_base (381)..(381): a, c, t, g, unknown or other
  modified_base (408)..(408): a, c, t, g, unknown or other
  modified_base (430)..(430): a, c, t, g, unknown or other
  modified_base (474)..(474): a, c, t, g, unknown or other
  modified_base (489)..(489): a, c, t, g, unknown or other
  modified_base (491)..(491): a, c, t, g, unknown or other
  modified_base (500)..(500): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtattagcagcaacgttgcctggtaccagcaagaaccnggccaggccncccgaggcctcctnatctatcgctgcactcccaccgagggcccagtggtacctccgagcctaggttcaggtggcaggtgggtctgggactagtagtctatctcacntcgagtcagcctgctagtcagtaattnttgacttaattagtactgtacngtacagttaatatagtggtcggtacgtcgagaaggacaaggtanaatacgaagttacgngngctgcactnttcttcgttcttc

SEQ ID NO: 442341 - DNA, 657 bp, Homo sapiens
  misc_feature: GZ8MTXP01CBJI8.2.7.A07.1.454.CMB.2.raw
  modified_base (200)..(200): a, c, t, g, unknown or other
  modified_base (271)..(271): a, c, t, g, unknown or other
  modified_base (290)..(290): a, c, t, g, unknown or other
  modified_base (496)..(496): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctaccgaaggggaaanacgcccaccctctcctgcgagggccagtcagagtatagcagctaacttacgctggtaccagacacgaaccnggcagcctccagcctcctnatctatcgctgcctactacccgacgacgggccctacgtcggtacctcccgagtccgtacggtcaggtcggcgtagggttcggggttacgtgggggactagggtacgtttctacgtttccacaccctatcgaagctacgtccgtagacgtagttacgtagtaacgttatttacgactttaagttttacttacgttgtacctaaggtntaaagttaaagttaacgttaacggtcgggttacgggtaaccggtttaccgggaaccggtaaacgggtaaaccgttaaagggtaaacgaaaacgtaaacgaaaccggttagttcggttacggtctcgaacctaactcgttacgttaacgttccctttaaccg

SEQ ID NO: 442342 - DNA, 525 bp, Homo sapiens
  misc_feature: GZ8MTXP01CBXRE.2.7.A07.1.454.CMB.2.raw
  modified_base (196)..(196): a, c, t, g, unknown or other
  modified_base (263)..(263): a, c, t, g, unknown or other
  modified_base (399)..(399): a, c, t, g, unknown or other
  modified_base (479)..(479): a, c, t, g, unknown or other
  modified_base (510)..(510): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaaccnggccaggctcccaggctcctcatctatgctgcatccaccgagggcccacgtggtactcccagccaggttcagtggcaggtgggtctggggacaggtattcattctcaccatcagcacgcctgctagtctagaagtntttgattaatttagttacttgtccagtctaagtataagttaacgtgggtaggacgttcggacgtaaagggacaagggtanaaagtaacgaacgttacgttgagctgcaccngttctgttcttaacc

SEQ ID NO: 442343 - DNA, 699 bp, Homo sapiens
  misc_feature: GZ8MTXP01AMEV4.2.7.A07.1.454.CMB.2.raw
  modified_base (198)..(198): a, c, t, g, unknown or other
  modified_base (264)..(264): a, c, t, g, unknown or other
  modified_base (679)..(679): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcagggccagtcagagtatagcagcaacttgcctggaccagcaacgaaccnggaccaggcctcccgaggtcctcctcatcctatcgctgcacgtcccacgacgggccctagtcggtaacctcccgagtcccgtaggtttccagggttcggccgtaggggttcggggtaccgtgggggaacctaagggtacgtttacctactttccgacctaccctagttccgaaggtcctaacggtccctaggacccgtaggttaccgtagggtaaagttacgtttttacggaaccttttaaagttttacggttacgttaggttaacctaacggttacctaaagtttaagtaaacgtttaaccgggtgggttacggggtaaccgttacgggaaccgtaaaggggaccttaaaggggtaacaaacgtaacgtaaaacggttacgttcggttacggtaacctacggaacctaaccgtnttacgttcgttcccgttaac

SEQ ID NO: 442344 - DNA, 752 bp, Homo sapiens
  misc_feature: GZ8MTXP01DSRED.2.7.A07.1.454.CMB.2.raw
  modified_base (196)..(196): a, c, t, g, unknown or other
  modified_base (717)..(717): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttagcctggtaccagcaagaaacctggaccaggcctcccaggcctcctcatctatgctcgcaactcccgaaccgacggggccctaacgttcgttaacctcccccgaggtcccgtaagggtttccgaagggttcgggaccgtaaggggttcgggggttaccgtaacggggggaaacctaaggggtacggttttacctaacgttttccctacgaaaccccgtaattacccaagggtcccaacgggtcccctttgggaccctaaggtttaccgttaagggtaaacggttaattttttaggaacctttaaaagtttttttaggtttaaacctttgggttacctaaaggtacctaaaggttaaatttaaagttaaaccggttggggtttaacgggtaccggtttaccgggaaccggtaaacgggtaaaccggaaagggttaaagttaaacgttaaacgaaacgttaaacgttggttacgggtntacgcgtaacccattacgttaacgttcgtttaacc

SEQ ID NO: 442345 - DNA, 551 bp, Homo sapiens
  misc_feature: GZ8MTXP01C51S1.2.7.A07.1.454.CMB.2.raw
  modified_base (196)..(196): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttactcttcctcctgctactctggctcccagatgccactggagaagtggtgatgacgcagtctccagccaccctgtctgtgtctccaggggaangccaccctctcctgcagggccagtcagagtattagcagcaacttagcctggtaccagcaagaaacctggccaggcctcccaggcctcctnatctatgctgcatcccacagggccagtggtactcccagccaggttcagtggcaggtcgggtctggggacaggtacgttcattcacaccatcagcagcctgctagtctagagtatttgacttaattttagttactggttcagtctaagttaataagttaacgtgggtacggtacgttcgggacgtaaaggggacaaaggggttaacaaacgtacgaaacgttacgttggttacggcttgcctaccgtattcgttgttcctttaacg

SEQ ID NO: 442346 - DNA, 594 bp, Homo sapiens
  misc_feature: GZ8MTXP01A05F3.2.7.A07.1.454.CMB.2.raw
  modified_base (197)..(197): a, c, t, g, unknown or other
  modified_base (268)..(268): a, c, t, g, unknown or other
  modified_base (460)..(460): a, c, t, g, unknown or other
  modified_base (536)..(536): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctaggtaccagcaagaaaccgnggaccaggcctaccgaggcctcctcatctatcgctgaccactccccgaacgacgggaccctacgttcggtaacctccccgaggtccccgtaagggttccaaggttcgggaccgtaggggttcggggtacctgggggaacctagggtacgtttccatttccacgacctatcagcagcctgcagtctagaattntttgacttaatttatactgtacagtataagtataagtacgtggtacgtacgtcggacgaaagggacaaagggtaanaaacgtacgaaacgttacgttgggttacgctagaactaccgattcctcgttcttaacc

SEQ ID NO: 442347 - DNA, 619 bp, Homo sapiens
  misc_feature: GZ8MTXP01D8UNX.2.7.A07.1.454.CMB.2.raw
  modified_base (198)..(198): a, c, t, g, unknown or other
  modified_base (304)..(304): a, c, t, g, unknown or other
  modified_base (338)..(338): a, c, t, g, unknown or other
  modified_base (372)..(372): a, c, t, g, unknown or other
  modified_base (426)..(426): a, c, t, g, unknown or other
  modified_base (437)..(437): a, c, t, g, unknown or other
  modified_base (582)..(582): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgcccaccctctcctgccagggccagtcagtagtattagcagctaacttacgcctggtaccagacaagaaacctggaccaggcctacccgaggcctcctcatctancgctgcactcccaccgcgggcccacgtggtaccnccgagcctaggttcaggtggcgtaggtggggtcngggggaactagggtacttctatttcactacccatcagcacggcctgtcgagttntacgtaagttntttagtactttaaattttacgttcgttagtaccagtactaagttaattaagtaaacgttgggtacggtaccgttacgggaacggtaaacgggtacgttaaacggtaagttaaacgtaaccgaaacggttaacgttggttaacgtntacgtaaccaccgtattccttaaccgttcttaacccg

SEQ ID NO: 442348 - DNA, 696 bp, Homo sapiens
  misc_feature: GZ8MTXP01BQSBN.2.7.A07.1.454.CMB.2.raw
  modified_base (197)..(197): a, c, t, g, unknown or other
  modified_base (263)..(263): a, c, t, g, unknown or other
  modified_base (285)..(285): a, c, t, g, unknown or other
  modified_base (383)..(383): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaanacgcccacctctcctgcagggccagtcagagtatagcagcaattgcctggtaccagacagaaaccnggccaggctaccaggctcctanatctatcgtctcgactactcccgaaccgacgggccctaagtcggtaacctacccgagtacccgtagggttcagggttcgaccgtaggtcggggttccnggggacctaagggtagttacaatttccacaaaccctagtcaagccgtagccctaggtaccaggttactaggtaaagttagtttttagactttaaaattttacgttaaacgtgtttaaccgaagtaccgttaaagttaaactaaagtttaaaccggttggggttaacgggtaacccggtttaccggggaaacccggaaaaggggttaacccgaaaaggggttaacaaaaacggttaaccgaaaaccggttaacgttggttaaccggggttccaagggaacctaacgtacgtttacttcggttccttttaacccg

SEQ ID NO: 442349 - DNA, 684 bp, Homo sapiens
  misc_feature: GZ8MTXP01A591X.2.7.A07.1.454.CMB.2.raw
  modified_base (197)..(197): a, c, t, g, unknown or other
  modified_base (263)..(263): a, c, t, g, unknown or other
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagcagaaccnggccaggctccaggcctcctnatctatcgctgcactcccaccgacgggcccacgtcggtactcccgagccgtacggttcaggtggacgtagggtcgggtcgtgggggactagggtacgtttccatttccgacaaccctagtcgaacggccacggtccctggtacgtaacggttctaaggtaaagttacttttacgaactttaaagttttacgttaacttggttaccaggtaaccttaaggttaaatttaaacgttacggttacggggttacggggtaaccggtttccggggaaacccggtaaaacgggggtaaccaaaagggggttaaacgaaaaccgtaaacggtaaaaacggttacggttcgggttacggaaccgttacggaaccttaacgtacgttacgttcgtttccgtttaacccg

SEQ ID NO: 442350 - DNA, 558 bp, Homo sapiens
  misc_feature: GZ8MTXP01B9FSG.2.7.A07.1.454.CMB.2.raw
  modified_base (197)..(197): a, c, t, g, unknown or other
  modified_base (279)..(279): a, c, t, g, unknown or other
  modified_base (410)..(410): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcgtccgggggaaancgccaccctctcctgcagggccagtcagagtatagcagcaacttgcctggtaccagcagaacctggccaggctccagctccnatcatgctgcactccacgagggcccacgtggtactcccagcctaggttcccaggtggcgtaggtcggggtctaggggaactaggtacgttcattcctacaccatcagcacgcctgctagtctagtaacgtntttgacttaatttcttacgtgtacagtactaagtaattaatacgtggtcggtacgttcggacgtaaagggaactaagggttaagaaacttacgaaacgtacgttggttcggactggacctaacctatccgttacgttccttctaaccg

SEQ ID NO: 442351 - DNA, 634 bp, Homo sapiens
  misc_feature: GZ8MTXP01A6UHK.2.7.A07.1.454.CMB.2.raw
  modified_base (196)..(196): a, c, t, g, unknown or other
  modified_base (450)..(450): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaancgccaccctctcctgcagggccagtcagagtatagcagcaacttgcctggtaccagcaagaacctggaccaggcctcccgaggcctcctcatctatcgctgcactcccaccgacgggcccaacgttcggtaacctccccgaggtcccgtaacgggttccaagggttcggcctaggggttcggggtaccgtgggggaactaaggtacgtttaactctacgaccatcgagcacggcctgctaagtctagtaagttntttagacttaaattttatacgtgtactagtactaagttaactaaagttaacggtgggttacggtaacccggttaccggggaaaccgaaacgggggtaaccctaaaagggggttaaacaaaacgttcggaaaaacggtaacgttggttcggctaacggcaaccgtagtcttcgttcttcgtaacc

SEQ ID NO: 442352 - DNA, 547 bp, Homo sapiens
  misc_feature: GZ8MTXP01BHHP3.2.7.A07.1.454.CMB.2.raw
  modified_base (197)..(197): a, c, t, g, unknown or other
  modified_base (263)..(263): a, c, t, g, unknown or other
  modified_base (405)..(405): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagcagaaccnggccaggctccgaggctcctcatctatgctgcatccacgagggccagtgtactccagtcctaggttcagtcggcaggttgggctggggacaggtcgttcagtttccacaccatccagcagtcctgactaggtctagtaattntttgacttaatttacgtacttgtacagtactaagttaattaagtaacgttgggtacggtaacgttcggaacgtaaaggggaaccaaagggtaagaaactacgaaagacgttggagctagctacctagttcctgttcctaacg

SEQ ID NO: 442353 - DNA, 743 bp, Homo sapiens
  misc_feature: GZ8MTXP01E1ULN.2.7.A07.1.454.CMB.2.raw
  modified_base (197)..(197): a, c, t, g, unknown or other
  modified_base (265)..(265): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctggtaccagacaagaaccnggccaggcctcccgaggcctcctcatctatcgctgccactcccaccgacgggccctacgtcggtactccccgagtccgtacggttccgaggtcggacgtagggttcggggtcgtgggggaactagggtaacgttcctactttcccgtacctaaccctactacgtacggaccgacggtccctacggtaccgtaggttaccgttaggtaaagttacgttttacggtaactttaaagtttttaacgtttaaccgttagttaccgtaaggtaacctaaagtttaaagttaaacggtttaaaccgttgggggttacggggttaacccgggtttaccggggaaaccccggtaaaacgggggtaaaccggttaaaacggggttaaaacgttaaaacgttaaccggtaaaaaacggttaaccggttaggttacgggtaacgtaccggaaccgtaaccctagttccgttaacgtttccgtttaaccc

SEQ ID NO: 442354 - DNA, 666 bp, Homo sapiens
  misc_feature: GZ8MTXP01AMVBU.2.7.A07.1.454.CMB.2.raw
  modified_base (196)..(196): a, c, t, g, unknown or other
  modified_base (263)..(263): a, c, t, g, unknown or other
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaagggaaancgcccaccctctcctgcgagggccagtcagagtatagcagcaattgcctggaccagcaacgaaccgnggccaggcctcccgaggcctcctnatctatcgctgcactcccgacgacgggccctaacgtcggtacctcccaggccgtacggttcaggtggcgaggttggggtccgtgggggtaacagggttacgttcactttccgaccactatcgagcgacgtcctgacctaagttcttaggtaaagttgttttacgaactttaaatttttacggttacgttagtacctaggtaacttaaaggttaaatttaaacggttaaccggttggggttaacgggtacccggttaaccgggaccggtaaaacgggggtaaccttaaaaggggttaaagaaaacgttaacgggaaaaccggttacgttgggttaccggtctacgaaccctaccgtatttacccgttcgttccttaaccg

SEQ ID NO: 442355 - DNA, 794 bp, Homo sapiens
  misc_feature: GZ8MTXP01EN2UD.2.7.A07.1.454.CMB.2.raw
  modified_base (198)..(198): a, c, t, g, unknown or other
  modified_base (295)..(295): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgccaccctctcctgcagggccagtcagagtattagcagcaacttagcctaggtaccagacaacgaaacctggaccagggcctcccaggcctcctanatctatgctgcactcccgaacgacgggaccctaacgttcgtactacccgagtcccgtaaggttccaaggttcgggaccgtaggggttcggggtaccgtaaggggggaacctaaaggggttacgtttaccgtattttaccccgtacaaaccccttagtacccgaaggtacccgaaacggttccccgttagggtaccctaaaggtttccgttaaacggggtaaaatttaccgttttttaagaaaccgtttttaaaatttttttacgggggttaaaccctttggggtttaaaccaacgggttaaccttaaacgtttaaaagtttaaaacgttaacggggtttcgggtaaacgggttaacccggtttaccgggggaaaccgtaaaaacgggggtaaccgttaaaaggggttaaacttaaacgttaaaccgaaaaaccggttaacgttgggttacggaacctaggaacccttaacccgtatttcgttccggtttaactttcccg

SEQ ID NO: 442356 - DNA, 697 bp, Homo sapiens
  misc_feature: GZ8MTXP01CABYS.2.7.A07.1.454.CMB.2.raw
  modified_base (198)..(198): a, c, t, g, unknown or other
  modified_base (263)..(263): a, c, t, g, unknown or other
  modified_base (283)..(283): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgccaccctctcctgcagggccagtcagagtatagcagcaacttagcctggtaccagcagaaccnggccaggctccaggctcctnatctatgctcgcactccaccgacgggccacgttggactcccagtcctaggttcaggtcgacgaggtgggtctggggactagggtcgttccagtttccacgacctataccgagtcacgcccttaggacctaaggttaccgtaaggtaaacgttacgttttttacggaaactttaaactttttaacgggtttaccgttggtttaaaccgaaggttaaccttaaagggttaaactttaaacgtttaaacccggggtttagggttaccgggggttaaccgtttaccggggaaaccggtaaaacgggggtaaaccgttaaaggggtaaacggttaaactaaaccggtaaacggttaacgttgggttacggtaaccgttaggaacccttacgtacgttccttaacgttccgtttaacccg

SEQ ID NO: 442357 - DNA, 658 bp, Homo sapiens
  misc_feature: GZ8MTXP01BRC25.2.7.A07.1.454.CMB.2.raw
  modified_base (199)..(199): a, c, t, g, unknown or other
  modified_base (479)..(479): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctccgaaggggaaanacgcccaccctctcctgcagggccagtcagagtatagcagactaacgttagcctaggtacccagacaacgaaaccgtggaccagggccctcccgaggcctccctctactctatcgctgcctactcccaaccgacgggcctacgtcgtactccccgagcccgtacggttcgaggtcggacgtagggtcgggttacgtggggaacagggttacgttcctactttcctacaaccctatccgaacgctacgccctggacctaggttctaaggtaattagtttanacttaattttactacgttgtacagtactaaggttaataagttaacggtggtcggtacggtacccgggaacggtaaaggggaccgttaaagggtaaagaaagtaaaccggtaaaacgttaccggttggttacgtaaccgtacgaacctaaccgtctttacggtaaccgtttcgttaaccc

SEQ ID NO: 442358 - DNA, 663 bp, Homo sapiens
  misc_feature: GZ8MTXP01EAQPB.2.7.A07.1.454.CMB.2.raw
  modified_base (197)..(197): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccacctctcctgcagggccagtcagagtatagcagcaactagcctggtaccagcaagaaccnggccaggcctcccgaggcctcctcatctatcgctgacactccgaccgacgggcctacgtggtacctcccgagcccgtaggttcaggtcggcgtagggtcggggtacgtgggggactagggtagttcctagtttccactaccgtactcaagcacgcctagacgtacgtacgtagtaacgttatttacgtattaacttttacttacgtagtaccgtagtacgtaagttaagtaaacgttaacggttgggttacgggtaccggtttaccgggaaaccggtaaacggggtaaaccgttaaagggttaaacgaaaacgtaaaccggtaaaaaccgttacggttacggttacggtaaccgttacggaaccctaacgtacgttaccgtttaacgtttccgtttaacccg

SEQ ID NO: 442359 - DNA, 533 bp, Homo sapiens
  misc_feature: GZ8MTXP01AR9C3.2.7.A07.1.454.CMB.2.raw
  modified_base (197)..(197): a, c, t, g, unknown or other
  modified_base (262)..(262): a, c, t, g, unknown or other
  modified_base (405)..(405): a, c, t, g, unknown or other
  modified_base (510)..(510): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcagaaccnggccaggctccaggctcctcatctatgctgcactcccaccgagggcccagtggtactcccagccaggttccaggtggctaggtgggtctggggacaggtacgttcactttcacaccatcagcacgcctgcagtctagaagttntttgacttaatttactactgtacagtctagtataagtacgtgggtcgtacgttcggacgtaagggacaaagggtaacaaagtacgaaacgttagttggttacggntcgaacacctattcgtcgttctc

SEQ ID NO: 442360 - DNA, 725 bp, Homo sapiens
  misc_feature: GZ8MTXP01AP5B0.2.7.A07.1.454.CMB.2.raw
  modified_base (197)..(197): a, c, t, g, unknown or other
  modified_base (268)..(268): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcacgggccagtcagagtatagcagctaacttagcctggtaccagcaagaaaccnggaccaggcctcccgaggtcctcctcatcctatcgctgccaactccccgaaccgacggggaccctacggttcggtacctccccgagtcccgtaacgggttccagggttcggacgtaggggttcgggggtcctcgggggaaactagggtacgtttacctaacgtttcccaccctaacccagttaccgaacgtcgtaaccgcccttaggaccctagggttacctaagggtaactttaagttttacgaaacctttaaatttttacttacgttggtaacctaagggtacttaaaggttaaatttaaacgttaaccgggttggggttaacgggtaacccggttacgggaaaccggtaaaacggggtaaccgttaaaaggggtaacttaaaacgttaaaccaaaaggttacgttggttacggaacttacgaaccctaactacgttcgttaacgttcttaaccc

SEQ ID NO: 442361 - DNA, 695 bp, Homo sapiens
  misc_feature: GZ8MTXP01BW2LC.2.7.A07.1.454.CMB.2.raw
  modified_base (197)..(197): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaccnggccaggcctcccaggcctcctcatctatcgctgcactcccaccgacgggccacgtggtactcccgagcctaggttcaggtggccaggttcgggtctggggacaggtcgttccatttccactaccgtatccgagccgacgtcccgtggacctaggttccgtaggtaaacgttgtttttaacggactttaaacgttttttacgttaacgtttcggttaaccaaacggttaccgttaaagtttaaaccgtttaaagtttaaaccgggttagggggttaccgggttaacccgggtttaccggggaaacccggtaaaacgggggtaaacccgttaaaaggggttaaacgttaaaacgtaacccggtaaaacggttaaccggttggttacgggaaccttacggaaccttaaccgtattccgttaagtttccttaaccg

SEQ ID NO: 442362 - DNA, 533 bp, Homo sapiens
  misc_feature: GZ8MTXP01BJSIL.2.7.A07.1.454.CMB.2.raw
  modified_base (199)..(199): a, c, t, g, unknown or other
  modified_base (266)..(266): a, c, t, g, unknown or other
  modified_base (288)..(288): a, c, t, g, unknown or other
  modified_base (405)..(405): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaancgccaccctctcctgcagggccagtcagagtatagcagcaacttagcctggtaccagcaagaaaccnggccaggctcccgaggctcctnatctatgctgcatccacagggccacgtggtactcccagccaggttcagtggctaggtgggttctggggacaggagtttcattctcacatcagcagcctgacagtctaggaatatttnacttaatttagttactgtacagtctaagtaataaagtacgtggtcggtacgtcgacgtaaacgggacgaaaggtaagaaactaacgaaacgagttgttacggctagcactagttcttaacgttcctaa

SEQ ID NO: 442363 - DNA, 550 bp, Homo sapiens
  misc_feature: GZ8MTXP01D5LQM.2.7.A07.1.454.CMB.2.raw
  modified_base (197)..(197): a, c, t, g, unknown or other
  modified_base (265)..(265): a, c, t, g, unknown or other
  modified_base (286)..(286): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcaagaaccnggccaggctcccaggctcctnatctatgctgcactcccaccgagggccctacgtggtactcccgagccctaggttcagtggctaggtcgggtctgggganagacgttcattctacactatcagcagccctgcctagtcgtagtaagttattttgacttaatttattacttgtacagtactagtactaatacgtggtgtacgtcggccgaaaggaccttaaagggtacaaacgttacgaaaacggaacttgggttacggctcggaaccactattctcgttcttaac

SEQ ID NO: 442364 - DNA, 663 bp, Homo sapiens
  misc_feature: GZ8MTXP01B2LDN.2.7.A07.1.454.CMB.2.raw
  modified_base (198)..(198): a, c, t, g, unknown or other
  modified_base (260)..(260): a, c, t, g, unknown or other
  modified_base (276)..(276): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccacctctcctgcagggccagtcagatatagcagcaattgcctggtaccagcagaaccnggcaggctccagctcncatctatgctgcactcccgaccgacgggccctacgtcggtaactcccgagccgtaggttcaggtggctagggttcgggtcgtggggactagggtacgtttcacgtttccacaccctagttccgaacggtcacgtcccgtggtacccgtaggttcctaagggtaaacgttacttttacggtactttaaatttttcgttaccgttaggttacccgaggtaccttaaaggttacttaaacggttaaccggttggggtaacggtaccggttaccgggaaccgaaaagggggtaacccttaaagggtaaacgttaaacgtaaacgtaaacggttaacgttggttacgggtaacctcggaacctacgtacttaccgttcgtttcctttaaccg

SEQ ID NO: 442365 - DNA, 535 bp, Homo sapiens
  misc_feature: GZ8MTXP01BD241.2.7.A07.1.454.CMB.2.raw
  modified_base (199)..(199): a, c, t, g, unknown or other
  modified_base (294)..(294): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtattagcagcaacttagcctggtaccagcaagaaaccctggaccaggcctacccaggcctcctnatctatgctgcatccacagggccagtgactcccagccaggttcagtggctaggtgggtctggggacaggtacgttcatttcacacctatcagcagcctgacagtctagaagtatttgacttaaatttctaactgtacagacagttaataataacgtggtacgtacgttcggaccgaaagggaccaaaggtacgaaatacgaaaacgttacttggttcggctgaacaccattccttgttctc

SEQ ID NO: 442366 - DNA, 556 bp, Homo sapiens
  misc_feature: GZ8MTXP01BWTCA.2.7.A07.1.454.CMB.2.raw
  modified_base (197)..(197): a, c, t, g, unknown or other
  modified_base (262)..(262): a, c, t, g, unknown or other
  modified_base (280)..(280): a, c, t, g, unknown or other
  modified_base (406)..(406): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcagaaccnggcaggctccagctcctnatctatgctgcatcccacgagggccacgtggtactcccagcctaggttcaggtggctaggtgggtctggggactaggtacgttcatttcacaaccatcagcacgcctgacctagtctagtaagttnttttcgacttaattttacttactgtacagtactaagttataaagtaacgtgggtacggaccgttcggaccgtaaagggaccgaaagggtaacgaaacgtacgaaaacgttacgttggttacgaactgaactaccgattcctgttcttaac

SEQ ID NO: 442367 - DNA, 538 bp, Homo sapiens
  misc_feature: GZ8MTXP01DFODQ.2.7.A07.1.454.CMB.2.raw
  modified_base (196)..(196): a, c, t, g, unknown or other
  modified_base (284)..(284): a, c, t, g, unknown or other
  modified_base (435)..(435): a, c, t, g, unknown or other
  modified_base (527)..(527): a, c, t, g, unknown or other
  modified_base (533)..(533): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccgaaggggaanacgccaccctctcctgcagggccagtcagagtatagcagcaacttgcctggtaccagcaagaaacctggccaggctccaggcctcctnatctatgctgcatccacgagggccagtgtactcccgagcctaggttcaggtggctaggtcgggtctggggaactaggtacgttcatttcgacaaccctatcgaagcaggccctaggactagttctaaggtaattatttgaacttaaatttnttaactgtacagtctaagtaataatacgtggtacgtacgtcggaacgaaagggacaaaggtagaaactacgaacagttgttagctgctacgnttcgtnttctc

SEQ ID NO: 442368 - DNA, 667 bp, Homo sapiens
  misc_feature: GZ8MTXP01DXLHQ.2.7.A07.1.454.CMB.2.raw
  modified_base (194)..(194): a, c, t, g, unknown or other
  modified_base (203)..(203): a, c, t, g, unknown or other
  modified_base (261)..(261): a, c, t, g, unknown or other
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccatggagaagtggtgatgacgcagtctccagccaccctgtctgtgtctcgaggggaancgccacctntcctgcagggccagtcagagtatagcagcaacttgcctggtaccagcaacgaaaccgnggccaggcctcccgaggcctcctnatctatcgctcgcactcccgacgacgggtccctacgttggtacctccccgaggtcccgtaaggtttccaaggttggaccgtagggttcggggtaccgtgggggaactagggtaacgtttcaacttttcacacctagtccgaagcgaacgtccgttagacgtacgttactaaggtaattagttttcgaacttaaatttttagttaacttggtacctaaggtactaaggttaattaagttaaacgttgggtaaggttaccgttacgggaaccgtaaaagggtaccgttaaagggttaaacgaaacgttaaacgaaacgggttaacgtttggaacggtccttaaaggccttaaaacccgttcgtttacgtttcgttccgttaacg

SEQ ID NO: 442369 - DNA, 637 bp, Homo sapiens
  misc_feature: GZ8MTXP01BY9LS.2.7.A07.1.454.CMB.2.raw
  modified_base (196)..(196): a, c, t, g, unknown or other
  modified_base (463)..(463): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanacgccaccctctcctgcagggccagtcagagtatagcagcaacttagcctggtaccagcaagaaacctggaccaggcctcccaggtcctcctcatctatcgctgcactcccaccggacgggccctacgtcggtaacctccccgaagtccctacgggtttccagggttcgggccgtaggggttcgggggtaccgtgggggaacctagggtacgtttcctacgtttccctacaccctagtcacgcacgcctgacctagtctagaagttntttagacttaatttagttactgtacagtactaagtataagtacgtgggtacggtacgttcgggaacgtaaacggggaaccgttaaagggtaaagaaacgttaaccgaaaacgttacgttggttacggaaccttaggaaccttaaccgtattaccgtttcgtttcgttttaaccc

SEQ ID NO: 442370 - DNA, 901 bp, Homo sapiens
  misc_feature: GZ8MTXP01ALYFF.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggaangcccaccctctcctgcagggccagtcagagtatagcagcaacttgcctggtaccagcagaaacctggccaggctcccaggcctcctcatctatgctgcactcccaccgagggccctacgtcggtactccccgagtcccgtaacggtttccaggttcggcgacgggttcgggggttaccgtaaggggggtaacctaagggtacggtttccgtaactttttcccgtaccaaaccccgtaattacccggaaacggtcccgaaaccggtccccgttacggacccgtaaggtttacccgtttaacgggtaaaagggtttaccttttttttaaggaaacccgtttttaaacgttttttaacgtttttaaaaccccggttggggtttaaacccctaaacgggggtttaaacccttaaaacggggttttaaaacgtttaaaaaaccgggttttaaaccgggggttttaaccggggggtttaaacccggggttaaaccccgggggttttaaccccgggggaaaccccgggttaaaaacggggggaaaccccgttaaaaaggggggtttaaacaaaaaaaccgggttaaccccggtaaaaaaacccgggggttaaacccgttttgggggaaaccggggtttccctaaaccggggaacccccgttaaacccgtaaacctttcccgggtttaaccgtttaaccccgtttttaacccg

SEQ ID NO: 442371 - DNA, 550 bp, Homo sapiens
  misc_feature: GZ8MTXP01EZYRG.2.7.A07.1.454.CMB.2.raw
  modified_base (197)..(197): a, c, t, g, unknown or other
  modified_base (263)..(263): a, c, t, g, unknown or other
  modified_base (318)..(318): a, c, t, g, unknown or other
  modified_base (371)..(371): a, c, t, g, unknown or other
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaaccnggccaggctcccaggctcctcatctatgctgcactccacgagggccactggtacncccgagccaggttcagtggcaggtgggtctggggacagagttcattcacaccntcagcagcctgccagtctagtaaagttntttagtacttaatttacgttacgtagtacagtataagttaattaagtacgtgggtacggtacggtccggaacgaaacgggtaacgttaaaggtaattaaacgtaacgaaacgttagttggacggtctcgaacctactattcgttcgttctc

SEQ ID NO: 442372 - DNA, 590 bp, Homo sapiens
  misc_feature: GZ8MTXP01CMO4E.2.7.A07.1.454.CMB.2.raw
  modified_base (197)..(197): a, c, t, g, unknown or other
  modified_base (263)..(263): a, c, t, g, unknown or other
  modified_base (534)..(534): a, c, t, g, unknown or other
  modified_base (577)..(577): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccacctctcctgcagggccagtcagagtatagcagcaacttagcctggtaccagcaagaaccnggaccaggcctcccgaggcctccctcatcctatcgctgaccactccccgaccgacgggccctaacgtcggtaacctcccgagtcccgtaaggtttccaggtggactagggttcggggtactgggggaactagggtagttcatttccacacctatcagcagccctgacgtagtctaggtaagttactttgacttaagttttatacgtgtacagtactaagttataaagtaacgtggtacggtacgtcgaaaccgaagggaacaaagggtaanaaacgttaacgaaacgttacgttggttaggctacgctaacgtnttctcgttctaac

SEQ ID NO: 442373 - DNA, 569 bp, Homo sapiens
  misc_feature: GZ8MTXP01BBTHY.2.7.A07.1.454.CMB.2.raw
  modified_base (198)..(198): a, c, t, g, unknown or other
  modified_base (435)..(435): a, c, t, g, unknown or other
  modified_base (552)..(552): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcagggccagtcagagtatagcagcaacttagcctggtaccagcaagaaaccgtggacccaggcctacccgaggcctcctcatctatgctgccactccccaccgagggccctagtcggtactcccgagccgtacggttcaggtcggctagggtcggggtctggggactagggtacgttctattcacaccgtatcgagctacgcctgacagttctagtaattntttgacttaatttagttactgtacagtactagtataagtagtggtgtacgtcgaacgaagggacaagggtaacaaagtacgaaacgttcgttggttacggtctacggctaacccgtnttccgttgttcccttcg

SEQ ID NO: 442374 - DNA, 617 bp, Homo sapiens
  misc_feature: GZ8MTXP01BQRDU.2.7.A07.1.454.CMB.2.raw
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaagacgccaccctctcctgcagggccagtcagagtatagcagcaacttacgcctggtaccagacaagaaaccnggccaggcctcccgaggcctcctcatctatcgctgccaactcccaccgacggggcccacgttcggtacctcccgagccgtaacggttcaggttcgggacgtagggtcggggtcgtgggggactagggtagttcctattcctacaaccctatccacgtcgacgtccctagactagttcgtaggtaagttcttttagaactttaaattttacgttaacttggtaccagtctaaagttaattaagtacggttgggtcggtaccgttaccgggaacgtaaagggaaccttaaaggtaacgaaagtaccgaaagttcgttgttacggtctgaaccactagttcttcgttcttaacc

SEQ ID NO: 442375 - DNA, 616 bp, Homo sapiens
  misc_feature: GZ8MTXP01CHRWC.2.7.A07.1.454.CMB.2.raw
  modified_base (269)..(269): a, c, t, g, unknown or other
  modified_base (597)..(597): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaagacgccaccctctcctgcagggccagtcagagtatagcagcaacttagcctaggtaccagacaacgaaaccgnggaccaggcctacccgaggtccctcctacatcctatcgactgacactcccgaccgacgggccctacgtcggtactcccgacgtccgtacggttcgaggtcgggcgtaggggtcgggtcgtggggactaagggttcggttctacgttccacgaacctactcgacgcacgtcctggactagttctagtaagttatttgactttaaattttattacgtgtacagtactaagtaattagtacgtggtcggtacgtacggacgaaaggtacgttaaaggtaacgaaacgtaacgaaacgttacggttggttacgtcgtacgctaaacccgttnttaccgttcgttcctaacg

SEQ ID NO: 442376 - DNA, 586 bp, Homo sapiens
  misc_feature: GZ8MTXP01B3X5X.2.7.A07.1.454.CMB.2.raw
  modified_base (198)..(198): a, c, t, g, unknown or other
  modified_base (207)..(207): a, c, t, g, unknown or other
  modified_base (262)..(262): a, c, t, g, unknown or other
  modified_base (285)..(285): a, c, t, g, unknown or other
  modified_base (416)..(416): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctntcctgcagggccagtcagagtatagcagcaacttagcctggtaccagcagaaccnggccaggcctcccaggcctcctnatctatgctgcatcccacgagggcctacgtggtactcccagccctaggttcagtggctaggtcgggtctggggacagggtagtttcagtttcctacaccctatcagcagccctgcctagtctaggaagttntttgacttaagttttacttactgtcagtctaagtattaagtaacgtggtacggtacgttcggaccgaaagggggtaccttaaagggtaacgaaagttaccgaaaacggttaccgttggttacgggtaactacggaacctaaccctagttccgttcgttccttttaacccg

SEQ ID NO: 442377 - DNA, 516 bp, Homo sapiens
  misc_feature: GZ8MTXP01D54CS.2.7.A07.1.454.CMB.2.raw
  modified_base (198)..(198): a, c, t, g, unknown or other
  modified_base (266)..(266): a, c, t, g, unknown or other
  modified_base (283)..(283): a, c, t, g, unknown or other
  modified_base (397)..(397): a, c, t, g, unknown or other
  modified_base (401)..(401): a, c, t, g, unknown or other
  modified_base (473)..(473): a, c, t, g, unknown or other
  modified_base (498)..(498): a, c, t, g, unknown or other
  modified_base (505)..(505): a, c, t, g, unknown or other
  modified_base (516)..(516): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagacaacttagcctggtaccagcaagaacnggcagctccaggctccncatcatcgctgcactccacgacgggccacgtgtactccagcctagttcagtgctaggtgggctgggacaggtacttcattcacaacctatcagcagcctgactgtactgtaatntttnattaaactttgtaactgtacagataataataataagttggtaggacgttcggacaaagggacaaaggtaaanaaagtaacgaaagttgttggagctnaactatnttctcgttctn

SEQ ID NO: 442378 - DNA, 813 bp, Homo sapiens
  misc_feature: GZ8MTXP01DLRBB.2.7.A07.1.454.CMB.2.raw
  modified_base (196)..(196): a, c, t, g, unknown or other
  modified_base (258)..(258): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagcaactgcctgtaccagcaagaacnggaccaggctccaggcctcctcatctatgactcgcactccgaaccgacgggggcccacggtacggttacctacccccgagtaccccgtagggttaccaacgggttgggacccgtaagggggttcgggggttacgttcggggggaaactagggtacgggtttccgtaactttcccgtaccgaaaccctacttaccgaacggtcccgaacggtccccgttagggacccgtagggtttaccgtaacggtaaacggtttattttacggaaaccttttaaagtttttaacggttttaaccttgggtttaaccctaaggtaaccgttaaaggttaaactttaaaacgtttaaacggttacgggggttaaccggggttaaaccgggtttaccggggaaacccggtaaaaacggggggtaaaccccgttaaaagggggtttaaaaaccggttaaaaccgtttaaaccgaaaaacccgggttaacgttcgggttaacgggggtaaccttaacggaacccttaaaccggtaacgtttccggttaacggttttcccgttttaaccg

SEQ ID NO: 442379 - DNA, 701 bp, Homo sapiens
  misc_feature: GZ8MTXP01CR80C.2.7.A07.1.454.CMB.2.raw
  modified_base (198)..(198): a, c, t, g, unknown or other
  modified_base (267)..(267): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcagggccagtcagtagtatagcagctaacttgcctaggtaccagcaagaaccnggaccaggcctcccgaggtcctcctcatctatcgctgccactcccaccgacgggccacgtcggtactcccgagtccgtaacggttccaggtcggacgtaggggttcggggtaccgtgggggaactagggtacggttttaccaacgtttccctaacgaaccctacgttacgaacggtccaacggtccccgtaggacccttaggttccgtaaaggtaagtttacttttaacggaactttaaagttttacgttaccgttgtaccgtaaggtacttaaaggttaattaaacggttaacggtggggttacggtaccggttaccgggaaaccggtaaacggggtaaaccttaaaggggttaaacaaacgttaaaccggaaacgttacggttggttaccgaacttacgaacctacccgtattcctcgttaacgtttaaccg

SEQ ID NO: 442380 - DNA, 527 bp, Homo sapiens
  misc_feature: GZ8MTXP01BDW6M.2.7.A07.1.454.CMB.2.raw
  modified_base (197)..(197): a, c, t, g, unknown or other
  modified_base (263)..(263): a, c, t, g, unknown or other
  modified_base (286)..(286): a, c, t, g, unknown or other
  modified_base (372)..(372): a, c, t, g, unknown or other
  modified_base (377)..(377): a, c, t, g, unknown or other
  modified_base (404)..(404): a, c, t, g, unknown or other
  modified_base (514)..(514): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttgcctggtaccagcaagaaccnggccaggcctcccaggcctcctnatctatgctgcatcccacgagggccagtggtactcccagcctaggttcaggtggctaggtgggtctggggacagtagttcagttcncaccntcagcacgcctgctagtctagaagttntttgacttaatttatacttgtacagctaagtataaatacgtggtacgtacgttcggacgaaagggtacaaaggtacgaaagtacgaaacgagttgttaggctagccacgnttcctgttcttcc

SEQ ID NO: 442381 - DNA, 572 bp, Homo sapiens
  misc_feature: GZ8MTXP01DOP5V.2.7.A07.1.454.CMB.2.raw
  modified_base (198)..(198): a, c, t, g, unknown or other
  modified_base (264)..(264): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaaggggaancgcccaccctctcctgcagggccagtcagagtatagcagcaattgcctggtaccagcaagaaaccnggccaggcctccaggcctcctnatctatgctgcactccacacgggccacgtggtacctcccgagccctaggttcaggtcggcgtaggtcggggtctgggggaacagggtagttccattctcaacctatcagcagcctagactagtctagaagttatttgacttaatttattactgttacagtactaagttaataagtaacgtgggtacggtacgttccgggacaaaggggtaccaaagggttaacaaaagttaccgaaaggttaaccgttggttacgggctagaacctaccgattctgttccttaacc

SEQ ID NO: 442382 - DNA, 565 bp, Homo sapiens
  misc_feature: GZ8MTXP01DD4NJ.2.7.A07.1.454.CMB.2.raw
  modified_base (197)..(197): a, c, t, g, unknown or other
  modified_base (262)..(262): a, c, t, g, unknown or other
  modified_base (284)..(284): a, c, t, g, unknown or other
  modified_base (425)..(425): a, c, t, g, unknown or other
  modified_base (549)..(549): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccacctctcctgcagggccagtcagagtattagcagcaacttgctggtaccagcaagaaaccnggccaggctcccgaggctcctnatctatgctcgcactcccacgacgggcccaacgtggtactcccgagcctaggttccaggtggcgtagggtcggggtctggggactagggtagtttcattctaccacatcaagcagtccctgactaggtctaggtaacgttntttgactttaaattttatacttgtacagtactaagttaataagtaacgtgggtacggtacgtcggacgaaagggtacaaagggtaagaaactacgaaacgttacgttgttacggctagccactnttcgttcttcttaacc

SEQ ID NO: 442383 - DNA, 742 bp, Homo sapiens
  misc_feature: GZ8MTXP01EDPMJ.2.7.A07.1.454.CMB.2.raw
  modified_base (724)..(724): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctcccagatgccactggagaagtggtgatgacgcagtctccagccaccctgtctgtgtctccgaaggggaaagcgcccaccctctcctgcgagggccagtcagtagttattagacagactaacgttacgccgtaggtaaccaggaccaaacggaaacccgtcgggacccacgggccctacccgaggtccctccctactactcctagtcgcttcgacctactccccgaaccggacgggcctacgtcggtacctccccgagtcccgtaggttcaggtggcctagggtcgggtacgtggggactagggtacgtttactacgtttccgactaacctagtaccaacggccgaacgggtcccttagggacccttaagttcgttaaagggtaaagtttactttttaagaaccttttaaaagttttttcttaacggttacgtaaccggtaataacgttaaaggtttaaacttaaacgttaccggggttggggttaaccgggttaccggttaacccggggaacggtaaaacggggtaaccgttaaaaggggtaaacttaaacgtaaaccggaaaacggttcgttggacgttaacgcgaactaaccgttnttcctaacgttcctaacg

SEQ ID NO: 442384 - DNA, 581 bp, Homo sapiens
  misc_feature: GZ8MTXP01ALQO1.2.7.A07.1.454.CMB.2.raw
  modified_base (198)..(198): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcagggccagtcagagtatagcagcaacttagcctggtaccagcagaaaccnggccaggcctcccaggcctcctcatctatcgctgcactcccaccgacgggcccacgtggtaacctccccgagcctacggttcaggtcggctagggtcgggtcgtggggactaggtagtttcacgtttctccacctatcaacggtcacgccctgctagtctaggaagttatttgacttaatttacttactgtcagtcaagttataagtacgtgggtacgtacggttacggcgaaagggacgaaaggtaacgaaagtacgaaaacggttacgttggttacgggtctcggaacctactagttcctcgttccttaaccg

SEQ ID NO: 442385 - DNA, 790 bp, Homo sapiens
  misc_feature: GZ8MTXP01BPP2R.2.7.A07.1.454.CMB.2.raw
  modified_base (194)..(194): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctcgagggaaancgccaccctctcctgcagggccagtcagtagtattagcagctaacttacgcctaggtaccagacaagaaaccgtggaccacggcctaccccgaggtcctcccgtacacttcctaagtcgccgtcgaccacctaccccgaaccgaccggggtccctaacgttcgggttaacctccccgaacggtccccgtagggtttccgaggttgggaccgtaggggttaacggggtcgtaagggggtaacctagggttacgtttacctaacgtttcctacctaaccctagttccgaacggtacgaccgtcccttagggacccttaggttacgttaaggtaaacgtttagttttaacggtaaccgttttaaagttttttaccttaaacggttcgttaacgtaacggtaaccgttaaaggtttaacttaaacgttaacggggttcgggggttaaccggttaccgggttttaaccggggaaaccgttaaaacggggggtaacccttaaaagggggtttaaacgaaaaccgttaacggtaaaaaccggttaacgttcggttacggaaccttagaaccctaacgtatttcccgtaagtttccgtttaacc

SEQ ID NO: 442386 - DNA, 618 bp, Homo sapiens
  misc_feature: GZ8MTXP01BPCGK.2.7.A07.1.454.CMB.2.raw
  modified_base (198)..(198): a, c, t, g, unknown or other
  modified_base (294)..(294): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcgagggccagtcagagtatagcagcaacttacgcctggtaccagcaagaacctggaccacggcctcccgaggtcctcctnatctatcgctgccactcccgacgtacgggcctaacgttcggtacctccccgaggtcccctaagggtttccaaggttcggaccgtaggggttcggggtccgtgggggaacctaagggtacgttcctaatttccgacacctatcagtcacgccctgacctagtacgtagtagttattttgaacttaatttatacttcgtacagtactaagttacttaaagttaccggtgggtacgtacggtcggaacgtaaaggggtaacttaaagggtaacgaaacgtacgaaacgttacgttgacggctacggcctacgattccgtcgttctcc

SEQ ID NO: 442387 - DNA, 666 bp, Homo sapiens
  misc_feature: GZ8MTXP01AV9OS.2.7.A07.1.454.CMB.2.raw
  modified_base (197)..(197): a, c, t, g, unknown or other
  modified_base (270)..(270): a, c, t, g, unknown or other
  modified_base (451)..(451): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcgagggccagtcagtagtattagcagctaacgttagcctaggtaccagcaagaaaccnggaccaggcctcccgaggtcctcctcatctatcgctgacactcccacgacgggccctagttcggtaaacctcccgaacggtccccgtaagggtttaccgagggttcgggaccgtaggggttcggggtaccgtgggggactagggtacgttctagttcctacaccctatcaggtcagtcccngacctgttcagtaattatttcgatttaatttacgttactggtacaacggtataaagttacttaaagtaacggttcgggtaacgtaccgggtttacgggaaccgtaaaggggtaaacccgttaaagggtaaacttaaacgtaacgtaaaaaccggttacgttgggttacggtaacgtacgtcctaacgtagttacgttaaccgttccgtttaaccg

SEQ ID NO: 442388 - DNA, 611 bp, Homo sapiens
  misc_feature: GZ8MTXP01CUC5U.2.7.A07.1.454.CMB.2.raw
  modified_base (197)..(197): a, c, t, g, unknown or other
  modified_base (268)..(268): a, c, t, g, unknown or other
  modified_base (293)..(293): a, c, t, g, unknown or other
  modified_base (448)..(448): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgcccacctctcctgcagggccagtcagagtatagcagactaacttagcctaggtaccagcaacgaaccnggccaggcctcccgaggtcctcctnactctatcgctcgaccactccccgaccgacgggcccacgtcggtacctcccgagtccgtacgggttccagggtcgacgtaggtcggggtcctggggactaggttagttacagttcctacacatacgacgcacgtcctgactagtctagtaagttntttagtactttaatttacggttactagttacacgtgtaaagttaactaagttacggtggtacggacggttaccgggaacgtaaagggtaacgttaaagggtaaacgaaagtaaccgtaaacgacgttggcggtaactgaacctagtacttctgttccttaacg

SEQ ID NO: 442389 - DNA, 565 bp, Homo sapiens
  misc_feature: GZ8MTXP01BNSGX.2.7.A07.1.454.CMB.2.raw
  modified_base (196)..(196): a, c, t, g, unknown or other
  modified_base (385)..(385): a, c, t, g, unknown or other
  modified_base (414)..(414): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcaagaaacctggccaggcctcccaggcctccctcactctatcgctcgcactcccaccgacgggcccacgtcggtactccccgagccctaggttccaggtggcagggtgggtctgggacagtagttcatttcncacctatcagcagcctgctgtctgaattntttgacttatttagtacttgtcagtctagtataagtaacgtgggtggtaccggttcgggaccgtaaagggaccttaaagggtaacgaaagtaccgaaacggttacgttcggttaggtcctaggaacctacgtattacgtcgttccgttaac

SEQ ID NO: 442390 - DNA, 626 bp, Homo sapiens
  misc_feature: GZ8MTXP01BB512.2.7.A07.1.454.CMB.2.raw
  modified_base (195)..(195): a, c, t, g, unknown or other
  modified_base (261)..(261): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctcccagatgccactggagaagtggtgatgacgcagtctccagccacctgtctgtgtctccgaaggggaancgccacctctcctgcgagggccagtcagtagtatagcagcaacttgcctggtaccagcaagaaccnggaccaggcctcccgaggcctcctcatctatgctcgcactcccgaccgacgggccctagtcggtactccccgagtccgtacggttccgaggttcggccgtaggggttcggggtccgtgggggacctagggtacgtttcactttccgacaaccctatacgaggaccagtcccttaggacctagttaccgtaggtaaattactttagaactttaagttttacgttactggttacaggtactaagttaagttaagttaacggtgggtacgtacggttacggacgtaaaagggaccttaaagggtaacaaacgtacgaaaacggttacgttggttacgaactcgaactacgtattcgtcgttcttaacc

SEQ ID NO: 442391 - DNA, 639 bp, Homo sapiens
  misc_feature: GZ8MTXP01ACVRQ.2.7.A07.1.454.CMB.2.raw
  modified_base (197)..(197): a, c, t, g, unknown or other
  modified_base (269)..(269): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggaaanacgcccaccctctcctgcagggccagtcagagtatagcagctaactagcctaggtacccagacagaaaccgnggccaggcctcccgaggtcctcctcattctatcgctgcactcccaccgagggcccacgtcggtaactcccgagccgtacggttcgaggtggaccgagggttcgggggtacctgggggaactagggtactttaccgtaatttcctaccaaccactcgaacgcgtaacgccttagaccgtaggttacttaggtaaagttattttaggactttaatttagttactgttacagtactaagtataaagttacgtggtcggacgttaccgggacgtaaacgggaacgttaaaggtaaagaaacgtaacgtaaaacggttacgttgggttacgtaacgtaggaacccttactacttacgtcgttaacccgttaaccc

SEQ ID NO: 442392 - DNA, 646 bp, Homo sapiens
  misc_feature: GZ8MTXP01ERHDX.2.7.A07.1.454.CMB.2.raw
  modified_base (199)..(199): a, c, t, g, unknown or other
  modified_base (265)..(265): a, c, t, g, unknown or other
  modified_base (290)..(290): a, c, t, g, unknown or other
  modified_base (612)..(612): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagcaacttgcctggaccagcaagaaaccnggaccaggcctaccgaggcctcctnatctatcgctgacctaactccccaaccgacgggccctaacgtggtaacctccccgagcccgtaagggtttccaaggttcgggacctaggggttcggggtctgggggaactaaggggtactttctaatttccacaaccctatccgaagccaaggtcccttagaccgtagttctagggtaaattacgtttagaacttaaattttattactgtacagtactaagttaattaacgttaacggtgggtacggtaccgttccgggaacgaaacgggaaccaaagggtaaacaaacgtaacgaaaaggttaaccgttgggttacggtcncgtaaccaacctattccgttcgttccctttaacc

SEQ ID NO: 442393 - DNA, 542 bp, Homo sapiens
  misc_feature: GZ8MTXP01DIW3O.2.7.A07.1.454.CMB.2.raw
  modified_base (199)..(199): a, c, t, g, unknown or other
  modified_base (267)..(267): a, c, t, g, unknown or other
  modified_base (290)..(290): a, c, t, g, unknown or other
  modified_base (376)..(376): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanacgccaccctctcctgcagggccagtcagagtattagcagcaacttgcctggtaccagcaagaaaccnggccaggcctcccgaggctcctnatctatgctgcactcccacgagggccacgtggtactcccagcctaggttcagtggcaggtgggtctggggacaggtagttcattcncaccatcagcagcctgacagtctaggaattatttgacttaattttatactgtcaggctaagtataataacgtggtacggtacgttcggaccgaaaggggtaccaaaggggtaacaaattacgaaacgttacgttggttacggctagaactaaccattctgttcttc

SEQ ID NO: 442394 - DNA, 686 bp, Homo sapiens
  misc_feature: GZ8MTXP01AFFMR.2.7.A07.1.454.CMB.2.raw
  modified_base (198)..(198): a, c, t, g, unknown or other
  modified_base (267)..(267): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcgagggccagtcagagtatagcagactaacttgcctggtaccagcagaaaccnggccaggcctcccgaggcctcctcatctatcgctgccactcccaccgacgggccctacgtcggtaactccccgagccgtaggttccaggtcggcgtaggtggggtcctggggacctagggtacgtttcatttccacaacctatcgaacgccgacggtcccttggacctaggttaccgtaaggtaaagtttacgttttacgacttttaaacgtttactttaacgttcggttacaacgtaacgttaaaggttaaattaaacgttaaacggttggggttacgggttaacccgggtttaaccgggaaccggtaaaacggggtaaacccgttaaaggggttaaacgaaaacgttaaccgaaaaacggttacgttggttacgggtaactacgaacctaacgtacttacgttcgttcctttaaccg

SEQ ID NO: 442395 - DNA, 643 bp, Homo sapiens
  misc_feature: GZ8MTXP01BJVC7.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaancgccaccctctcctgcgagggccagtcagagtatagcagcaattgcctggtaccagcaacgaaacctggaccaggcctcccgaggcctcctcatctatcgctgcactccacgacgggcccacgtcggtactcccgagccgtaacggttccaggtcggcgtagggtcgggtctgggggactaggtacgttactacgttctaccaacctctacgagccgtacgcccttaggacctacggttacgtagtaaagttagttttacggaactttaatttttaacgttacgttagtaccgtaagtacgtaagtttaaataagtttaaaccggtgggtacgggttaccggttaccgggaccgaaaaggggtccgttaaaaggtagttaaaacgtacggaaaacgttacgttgttacggtctacggctacccgtattccgtaagttccgttaacc

SEQ ID NO: 442396 - DNA, 759 bp, Homo sapiens
  misc_feature: GZ8MTXP01AMEHK.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaanagccaccctctcctgcagggccagtcagagtattagcagcaaacttagcctggtaccagacagaaacctggaccaggctcccaggcctcctcatctatcgctgcactccaccgagggcccacgttcggtactccccgagccccgtaaggtttccaggtcggggtacctaggggttcgggggttcccgttggggggaacctaagggtaacgggtttcctaacgttttcccacccgaaccctacgttaccgaacggtaccgaacgggtccccttaggaccccgttaaggttaccgttagggtaaaacggttattttttacggaacctttaaactttttaaggtttacttacggttactaacggtaacttaaaggttaaattaaacgtttaaacggttggggttaacgggttaaccgggttttacgggaaacccgggtaaaacgggggtaaacccgttaaaaggggttaaacgttaaaacgttaaaccgtaaaaacggttaacgtttgggttacgtaaccgttaggaaccctaacgtaacgttcttaacggtttcctttaaccg

SEQ ID NO: 442397 - DNA, 573 bp, Homo sapiens
  misc_feature: GZ8MTXP01CU8DD.2.7.A07.1.454.CMB.2.raw
  modified_base (196)..(196): a, c, t, g, unknown or other
  modified_base (260)..(260): a, c, t, g, unknown or other
  modified_base (280)..(280): a, c, t, g, unknown or other
  modified_base (441)..(441): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagcccaccctctcctgcagggccagtcagagtatagcagcaacttagcctggaccagcagaacnggccaggcctccagctcctnatctatgctgccatccccacgacgggcccacgtcggtactccccgaagtccctaagggtttccaggtcggacgtaggggttcggggtacctgggggacctagggtacgttcatttcacacctatcagcagcctgctagtctagattatttgacttaatttntactgtacatacgtaatataagtacgtggtgtaccggtacggactaaaggggaaccaagggtaaacaaacgttaaacggaacgttacgttggttacgtcgtacgtctaccgtattcctcgtttcgttaaccc

SEQ ID NO: 442398 - DNA, 794 bp, Homo sapiens
  misc_feature: GZ8MTXP01DKRDG.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaaggggaancgcccaccctctcctgcagggccagtcagagtatagcagcaacttgcctaggtaccagacaacgaaacccgtggacccacggcctacccgaggtcctccctcatctatcgctgcactaccccaccgacgggccacgttcggtactccccgagtcccgtaacgggttccagggtcggtccgtaggggttcggggttacgtgggggaactaagggtacgtttacctactttcctaccgaaaccctataccgacgggtccaacggtcccttaggaccgtaggttccgttaaaggttaaacgtttaatttttacggaaacctttaaagttttttaacgttaaccgttgttaaacccgtaaagggttaaccttaaaggtttaaactttaaaacggttaaaccggggtttgggggttaaaccggggttacccgggtttaaccggggaaaccccggtaaaaacgggggtaaacccttaaaagggggttaaaacgttaaaacgttaaacccggtaaaacgggttaaccggttgggttaacccgggtaaccgtaacggtaacccctaaccgttactttaccgtttaacggttccctttaaccccg

SEQ ID NO: 442399 - DNA, 631 bp, Homo sapiens
  misc_feature: GZ8MTXP01E4HAK.2.7.A07.1.454.CMB.2.raw
  modified_base (197)..(197): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcaagaaccnggccaggcctcccaggcctcctcatctatgctgcatcccaccgacgggccacgtcggtactccccgagccgtaggttcaggtggcgtaggtggggtctggggaacaggtacgtttcattcgacacccatacagcacgcccttggacctagttactaggtaagttagttttacgaactttaaattttacttaaccgtggttaaccaaggtactaaagttaaattaaacgttaacggtggggtaacgggtacggttaccgggaaacccgtaaagggggaaacccttaaaggggtaacgaaaaagttaaccgaaaacggttaacgttgggttacggaactcgaaccaacctattcgttcgttcgtttaacc

SEQ ID NO: 442400 - DNA, 572 bp, Homo sapiens
  misc_feature: GZ8MTXP01BJMS2.2.7.A07.1.454.CMB.2.raw
  modified_base (198)..(198): a, c, t, g, unknown or other
  modified_base (264)..(264): a, c, t, g, unknown or other
  modified_base (300)..(300): a, c, t, g, unknown or other
  modified_base (319)..(319): a, c, t, g, unknown or other
  modified_base (406)..(406): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgccaccctctcctgcagggccagtcagagtatagcagcaacttagcctggtaccagcaagaaccnggcaggctcccgaggcctcctcatctatgctgcacnccacgcgggccagtgtacnccgagcctaggtcagtggctaggtgggtctggggactaggtacttcattcacacctatcgacgcagtcctgacagttctagtaagtntttacgacttaatttcgtacgttgtccaagtactaagttataagttacgtgggtacggtacggttcggaccggtaaagggtaaccttaaagggtaacaaacgtaacgaaacgttaaggttcggacggtctacggaacctaacctgttacccgtgttcctttaaccg

SEQ ID NO: 442401 - DNA, 656 bp, Homo sapiens
  misc_feature: GZ8MTXP01C2XZD.2.7.A07.1.454.CMB.2.raw
  modified_base (196)..(196): a, c, t, g, unknown or other
  modified_base (262)..(262): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttagcctggaccagcaagaaccnggccaggcctcccgaggcctcctnatctatgctgcactcccgaccgacgggccacgtcggtactccccgagccgtacggttcaggtggccgtagggtcggggtctggggactaaggtacgttccatttccgacaaccatcgagccacggtccctaggactacgttctaggtaacgttagttttcgaactttaattttaacgttactggttacaagtactaaagttattaaagttaacggttgggttacgggtaccggttacgggaaccggtaaaacggggaaccgttaaagggggttaaacaaacgttaaaccgaaaacgggttaacgttcgggttacggtaaccgttccggaacctaacccgttagttacccgttaacggttccctttaaccg

SEQ ID NO: 442402 - DNA, 601 bp, Homo sapiens
  misc_feature: GZ8MTXP01A6PQY.2.7.A07.1.454.CMB.2.raw
  modified_base (196)..(196): a, c, t, g, unknown or other
  modified_base (265)..(265): a, c, t, g, unknown or other
  modified_base (552)..(552): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaancgccaccctctcctgcagggccagtcagagtatagcagacaacttgcctggtaccagacaagaaaccgnggccaggcctacccgaggcctacctctactctagtcgctcgcctacgtcccgaccgacgggccctacgtcggtactcccgagtcctacggttcaggtggcgtaggtcgggtcgtggggactagggtacgttctacgtttccactacctatcgaacgcaacggcctgtacgtaggttctaagggttaaagttactttagactttaaattttctaacgttgtacaacgtagtaacgtaataagtaccgttggggtacgtacggtcggaacgtaaagggacaaaggtaanaaacgtacgaagttacgttgttacgcctgaaccactgttctgttctaac

SEQ ID NO: 442403 - DNA, 693 bp, Homo sapiens
  misc_feature: GZ8MTXP01AY84S.2.7.A07.1.454.CMB.2.raw
  modified_base (262)..(262): a, c, t, g, unknown or other
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtatagcagcaattgcctggtaccagcaagaaccnggccaggcctccgaggcctcctnatcatgctgcactcccacgacgggcctacgtggtactcccagcctagggttcaggtggctagggtcgggtacgtggggactaggtagttcctatttccgactacctagtccgaacgccgacggtcccttgggacctacgggttacctaggttaaacggtttatttttacggaaccttttaaagtttttatttaaaccgttggtttaccctaaagggttacctaaaggttaaactttaaacgttaaaccggttgggggttaacgggtaaccgggtttaccggggaacccggtaaaagggggtaacccttaaaggggttaaaggaaaacctacgtaaaacccgggttacgtttggggaccgtcgttacggaacccgtaaccgtttacgttaccgttcgttcccgttaacg

SEQ ID NO: 442404 - DNA, 575 bp, Homo sapiens
  misc_feature: GZ8MTXP01BTI0O.2.7.A07.1.454.CMB.2.raw
  modified_base (192)..(192): a, c, t, g, unknown or other
  modified_base (201)..(201): a, c, t, g, unknown or other
  modified_base (204)..(204): a, c, t, g, unknown or other
  modified_base (252)..(252): a, c, t, g, unknown or other
  modified_base (266)..(266): a, c, t, g, unknown or other
  modified_base (421)..(421): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctccagatgccatggagaagtggtgatgacgcagtctccagccacctgtctgtgtctcgagggaancgccacctntcngcagggccagtcaagtagtatagcagcaattgctggaccagcagaacngcagctccagctcnatctatcgctgcactcccgacgacgggcctacgtcggtaactcccgagtccgtaggttcgaggtggactagggtgggtactggggactaagggtctttacgatttccacaacctatcgaacgcgacgcctagtaccgtaggttactaggtaattntttagaactttaatttgtactgtacagtatagtaataagtacgtggtggtaccgtacggaacgtaaaggaacttaaagggtaaacaaagtaacgaaacgttcgttggacggtctacgtaacctaacgtcgttacgttcgtttaacctttaaccg

SEQ ID NO: 442405 - DNA, 815 bp, Homo sapiens
  misc_feature: GZ8MTXP01DD2TB.2.7.A07.1.454.CMB.2.raw
  modified_base (193)..(193): a, c, t, g, unknown or other
  modified_base (260)..(260): a, c, t, g, unknown or other
tcagacgctcgacacacgaccggtgctcgatttagcacgtgtcgcaggggggaggaactgctcagttaggacccagacggaaccatggaagcccagcgcagcttctcttcctcctgctactctggctccagatgccactggagaagtggtgatgacgcagtctccagccacctgtctgtgtctcgaagggaancgccacctctctgcagggccagtcagagtatagcagctaaattgcctaggtacagacaagaaaccgnggaccgaggcctaccgacggtcctcctacacttctaatcgcgttcgacctacgtaccccgaaccggtaacggggtacccaccgttacgggttaacctaccccgacggtacccgtaaccggtttaccggacgggttacggaccggtaacgggttcgggggttacccgttaagggggaaccgtaaaggttaccgggtttactaacgtttacccttaccgaaaccctaacttacgaaacggtcctaacggcccttacggaccgttaaggttccgttaaagggtaaactttacgtttttaggaaccttttaaagttttttaacttaaccgtttagggtaactaaacgggtaccttaaaaggtttaacttaaaagtttaaaaccgggttgggggtttaaccgggtacccgggtttaaccggggaaaccggtaaaacgggggtaaacccttaaaggggttaaaacgttaaacgttaaaccgaaaaaccgggttacgtttgggacgggttaacttacggaaccctaacccgtattacgtttaaccggttaacgtttaacccg

SEQ ID NO: 442406 - DNA, 635 bp, Homo sapiens
  misc_feature: GZ8MTXP01CMRS2.2.7.A07.1.454.CMB.2.raw
  modified_base (197)..(197): a, c, t, g, unknown or other
  modified_base (278)..(278): a, c, t, g, unknown or other
  modified_base (312)..(312): a, c, t, g, unknown or other
  modified_base (510)..(510): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggcctccagatgccatggagaagtggtgatgacgcagtctccagcccaccctgtctgtgtcctccgaaggggaanacgcccaccctctcctgcgagggccaagtcagagtatagcagctaaacttagccgtaggtaccagacgaaacgaaacccgnggacccgacggcctaccccgaaggtcctccctanatcctatcgcctgaccactccccgaacgaccgggcctaacggtcggtaactccccaaggccctaaggttccgaggtcggacctaggggttcggggtactgggggacctaagggtacgtttcaactttccacacatcacgcaggccctagctaggttctagtaagtacttttgactttaatttacttacgtgttacaanactaagtaattaaataacggttggtacggtaacgttacggaaccggtaaagggtaacgaaagggtaacaaacgttaaagaaaccgagttcgaggaactagaacaacctgttactcgttcttaacc

SEQ ID NO: 442407 - DNA, 693 bp, Homo sapiens
  misc_feature: GZ8MTXP01D8Q53.2.7.A07.1.454.CMB.2.raw
  modified_base (197)..(197): a, c, t, g, unknown or other
  modified_base (265)..(265): a, c, t, g, unknown or other
  modified_base (297)..(297): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaancgccaccctctcctgcagggccagtcagagtatagcagactaactcgcctaggtaccagcaagaaccnggccaggcctcccgaggcctcctcatctatcnctcgcactcccgaccgacgggcctacgtggtacctcccgagtccgtacggttcaggtcggactagggttcggggtactggggactaggtacgttactaacgttcctacactactcgaacgccgacgtcctagacgtaggttaccgtaaggtaagtttacgtttagaactttaaacgtttttacttaacgttgtaacaacgtgtaaagttaacttaaacgttaaccggtgggttaaccggtaccggtttaacgggaacccggtaaaaacggggtaaccgttaaaaggggttaaacgttaaaaccgtaaacccggtaaaaaacggttaccgttgggttaccgggtaacttacgaaccgtaacccctagtttccgttaacggtttccgttttaaccccg

SEQ ID NO: 442408 - DNA, 605 bp, Homo sapiens
  misc_feature: GZ8MTXP01CHY1M.2.7.A07.1.454.CMB.2.raw
  modified_base (197)..(197): a, c, t, g, unknown or other
  modified_base (427)..(427): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagacaagaaacctggaccaggcctcccgaggtcctcctcatctatgctgcactccacgacgggccacgtgtactcccgagccgtacggttcaggtggcgtaggtcggggtcgtggggactagggtagtttcacttccacgaccctatcacgtcagcctgacagtctagtaagttnttttagactttaaattttagttacgttgtacagtactaagttaataacgttaacggtgggttacggtaccggttccgggaaccgtaaaggggtaaccgaaagggtaaacgaaacgtaaacggaaacgttacgttggttacggtctacgccctaacgtacttccgtcgttccttaaccg

SEQ ID NO: 442409 - DNA, 641 bp, Homo sapiens
  misc_feature: GZ8MTXP01BUFFU.2.7.A07.1.454.CMB.2.raw
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgcccaccctctcctgcagggccagtcagagtatagcagcaacttagcctggtaccagcaagaaaccnggccaggcctcccgaggcctcctcatctatcgctgcactcccacgacgggccctacgtggtactccccgagcccgtaggttccaggtcggctaggtggggtaccgtgggggaacctagggtacgttcacgtttccacaacctactacgaacgtcgacgtccgtaggtaccgtagttacgtaagggtaaactttacgtttacgaacttttaaagtttttaacttacgtttacggtacaagtacgtaagttaaactaagttacggtaggtacggtaccgttaccggaacggtaaacggacgttaaaggtaaacgaaacgtaacgaaacggttagttcggaggtctacgaacctacgtacttcgtcgtttcttaaccg

SEQ ID NO: 442410 - DNA, 573 bp, Homo sapiens
  misc_feature: GZ8MTXP01EBSZ6.2.7.A07.1.454.CMB.2.raw
  modified_base (196)..(196): a, c, t, g, unknown or other
  modified_base (263)..(263): a, c, t, g, unknown or other
  modified_base (388)..(388): a, c, t, g, unknown or other
  modified_base (402)..(402): a, c, t, g, unknown or other
  modified_base (409)..(409): a, c, t, g, unknown or other
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagctaacttgcctggtaccagacaagaaccnggaccaggcctcccaggcctcctcatctatcgctgacactcccgaccgacgggcctacgttcggtactcccagtcctaaggttcaggtggctaggtcgggtctggggactaggtacgttcattcncaccatcagcagcngctagtntagagtntttgacttatttattactgtcagtactagtaataagtaacgtggtacgtacgttcggacgtaaagggtaaccttaaagggtaaacaaacgtacgaaaaccggttagttgggttacgggtctacggtaactaccctattccgtttcgttccttaaccc

SEQ ID NO: 442411 - DNA, 682 bp, Homo sapiens
  misc_feature: GZ8MTXP01CXF22.2.7.A07.1.454.CMB.2.raw
  modified_base (196)..(196): a, c, t, g, unknown or other
  modified_base (262)..(262): a, c, t, g, unknown or other
  modified_base (289)..(289): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttgcctggtaccagcaagaaccnggaccaggcctcccgaggtcctccctnatctatgctgcactaccaccgagggccacgttcggtactcccgagccctaggttcaggtggcgtaggtcgggtctgggggactagggtagtttcatttccgacaacgtatcaaggcctacggcccttaggactagtcgttaaggaattacgtttagactttaaacgttttaggttaacttcgggttacctaaggacctttaaaggtatttaaaacgttaacgggttcgggttaccgggtaaacggtttacccggggaaacccggtaaaaggggtaacccgttaaaaggggttaaacgaaaacgttaaacccggtaaacggttaaaaggttcgggttacgggccttaaggaaccccgttaactcgtttaccgttccgttaaccgttttaacccg

SEQ ID NO: 442412 - DNA, 648 bp, Homo sapiens
  misc_feature: GZ8MTXP01BF7A2.2.7.A07.1.454.CMB.2.raw
  modified_base (197)..(197): a, c, t, g, unknown or other
  modified_base (265)..(265): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagcaacttagcctggtaccagcagaaaccnggccaggcctcccaggcctcctcatctatgctgcatccacgagggccacgtggtactcccagccaggttcaggtggctaggtcgggtctggggactagggtacgtttcaacgtttcctacaaccctagtcaagccaacgtcccttaggacctaggttacctaggtaaagttatttttagaacctttaaatttttacgttacgttggttaccaaggtacctaagttaacttaaagttaaacggttgggttacgggtaccggtttaccgggaaccgtaaaagggggtaacccttaaaaggggttaaacgaaacgttaaaccgaaaacggttacgttaggcgggtaactacggaacctaccgtattccgttgtttcccgttaaccg

SEQ ID NO: 442413 - DNA, 652 bp, Homo sapiens
  misc_feature: GZ8MTXP01DS04R.2.7.A07.1.454.CMB.2.raw
  modified_base (197)..(197): a, c, t, g, unknown or other
  modified_base (262)..(262): a, c, t, g, unknown or other
tcagacgctcgacacacgaccggtgctcgatttagcacgtgtcgcaggggggaggaactgctcagttaggacccagacggaaccatggaagccccagcgcagcttctctttcctcctgctactctggctcccagatgccactggagaagtggtgatgacgcagtctccagccaccctgtctgtgtctcgaggggaancgccacctctctgcagggccagtcagagtatagcagctaattcgcctggtaccagcaacgaaccnggaccaggcctaccgaggtcctccgtcagtctatcgctgaccactcccgaaccgtacgggacctacgttggtacctccccgagtcccgtaggttccgaggtcggacgtagggtcgggtctggggactaggtacgttactacttctaccgaccctagtacgacggcaacggtccgttagaccgtagtactaaggtaaagttacgtttacggaactttaaagttttacggttacttagttacgaacgtataaagttaacttaaagtaacgttgggtacggtaacgttcgggaacggtaaaagggtaccgttaaagggtaaacgaaacgttaacgaaacggttaacgttggttacggctaacgcgtacctagttcttaacgttccgtttaacg

SEQ ID NO: 442414 - DNA, 642 bp, Homo sapiens
  misc_feature: GZ8MTXP01BOW1Z.2.7.A07.1.454.CMB.2.raw
  modified_base (196)..(196): a, c, t, g, unknown or other
  modified_base (576)..(576): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagctaacttgcctaggtaccagcaagaacctggaccaggcctaccgaggtcctcctacatctagtgctcgactactcccgacgacgggccctacgtcggtactccccgagtccgtacggttccaggtcggacgtgggttacggggtccgtggggactagggtacgtttcctacgtttccacaacctatcgaacgccgaacgcccgttggaccttaggttactaggtaaagttcttttagaacctttaaagttttacggttaactgtaaccaggtactagtaactaagttaacggtgggtaacgtacgttacgggaacccgtaaagggtacccgttaaagggtanaaaacgtcgaaaacggttacgttcggaggtcctcgaacctaacgtattccgttgttcccgttaacc

SEQ ID NO: 442415 - DNA, 672 bp, Homo sapiens
  misc_feature: GZ8MTXP01B4MA1.2.7.A07.1.454.CMB.2.raw
  modified_base (197)..(197): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttgccgtggtaccagacaagaaccnggccaggcctacccaggcctcctcatctatcgctgcactcccacgcgggccacgtgacctcccgagccgtacggttcagggtcggacgtagggttcggggtccgttgggggaactagggttacgtttcctacgttacctacccgaaccctagtacgacggtccacggtcctacggacttacgtacgtaggtaaattcgtttagtactttaattttaaggtacttgttacgaggtactaaaggttaataaacggttacgtcgggttacggtaaccgttaccgggaaccgtaaacggggtaaccgttaaaagggttaaaccggaaacttaaaccggaaaacgttacggttcggttacggtaactaccggtaactaccgttattccggtttcgttaacccgtttaaccg

SEQ ID NO: 442416 - DNA, 652 bp, Homo sapiens
  misc_feature: GZ8MTXP01CM29V.2.7.A07.1.454.CMB.2.raw
  modified_base (198)..(198): a, c, t, g, unknown or other
  modified_base (262)..(262): a, c, t, g, unknown or other
  modified_base (282)..(282): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgcccaccctctcctgcagggccagtcagatatagcagcaacttagcctggaccagcagaaccnggccagctccaggcctcctnatctatcgctgcactcccaccgagggcccacgtggtactcccgagccctagggttccaggtggctagggtcggggtactgggggacagggtagtttcagttcctacaccctatccaggtccacggcccttggacctaggtctaggtaagttatttaggacttaaattttacgttacgtcggttacaacggtactaaggttaattaaacgttaaacggttggggttacgggtaacccggtttaccggggaaccggtaaaacgggggtaaccgaaagggggttaaacaaaacgttaaaccgaaacgggttaaccgttggttacgggaaccttacggaacctaaccgtacgttccgttcggttcctttaaccg

SEQ ID NO: 442417 - DNA, 620 bp, Homo sapiens
  misc_feature: GZ8MTXP01BSPPT.2.7.A07.1.454.CMB.2.raw
  modified_base (196)..(196): a, c, t, g, unknown or other
  modified_base (260)..(260): a, c, t, g, unknown or other
  modified_base (277)..(277): a, c, t, g, unknown or other
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaancgccaccctctcctgcagggccagtcagtagtatagcagcaacttgcctggtaccagcagaacngcaggctccaggctctnatctatgctgcatcccaccgcgggccacgtggtactcccgagcctagggttccaggtggcgtaggtcggggtctggggacaggtacgtttcatttccgacacccatcagtcacgcctgacgtagttactagtaaggttntttagactttaaatttacgttactgttaccagtacgtaagttaataaacgttaacggtcggggtacgggtacgggtttaccgggaaccggtaaaagggggtaacccttaaaggggtaaacgaaacgttaaaccggaaaaacggttacgttacgggacggtaacgtacggaacctaaccgtacgttaccgttgttcctttaaccg

SEQ ID NO: 442418 - DNA, 656 bp, Homo sapiens
  misc_feature: GZ8MTXP01DJ9DR.2.7.A07.1.454.CMB.2.raw
  modified_base (198)..(198): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacacagtctccagccaccctgtctgtgtctccgaaggggaanacgccaccctctcctgcgagggccagtcagagtatagcagcaacttgcctggtaccagcaacgaaaccgtggaccacggcctacccgaggtccctccctacacttctatcgcctcgacctactccccgaacccggacgggtaccctacgttcggtacctccccgaggtccccgtaggttcaggttggcgtagggtcggggtctggggactaggtagttctacttctacacctatcgaggtccagtccctagacgtagttctagggtaacttagtttcgaaactttaattttacgttacttgtacaagttacgtaaattaactaagttaacggtggtacgggttaccggtaccggaacggtaaacgggtaacgaaagggttaaacgaaacgttaaccgaaaagggttaacgttcgggttacggtaacctacgaaccttaacagtttctcgttcttaacc

SEQ ID NO: 442419 - DNA, 564 bp, Homo sapiens
  misc_feature: GZ8MTXP01BAVSB.2.7.A07.1.454.CMB.2.raw
  modified_base (198)..(198): a, c, t, g, unknown or other
  modified_base (400)..(400): a, c, t, g, unknown or other
  modified_base (433)..(433): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcgagggccagtcagagtatagcagcaacttgcctggtaccagcaagaaacctggaccaggcctacccgaggcctccgtcatctatcgctgaccactacccaccgacgggcctacgtcggtactccccgaggcctacgggttcaggtggcgtaggtcgggtctggggacctaggtacgttcagttcncaacctatcagcagcctgctagtctagaagttntttgacttaatttgtactgtacagtctaagtattaagtacgtggtcgtacgttcgacgaaagggaacaagggtaacaagtaacgaaacgttacgttggttacgaatcgaactcagttcctgttccttaacg

SEQ ID NO: 442420 - DNA, 708 bp, Homo sapiens
  misc_feature: GZ8MTXP01BOQRG.2.7.A07.1.454.CMB.2.raw
  modified_base (198)..(198): a, c, t, g, unknown or other
  modified_base (266)..(266): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcagggccagtcagagtatagcagcaacttagcctggtaccagcaagaaccngcaggcctccaggcctcctnatctatcgctgccatcccaccgacgggccaacgtcggtactccccgaggtcccgtaaggttccaggtcggcgtagggttcggggtccgtgggggaacctaggggtactttctaacgtttaccaccgtaaaccctataccgaacggtcctaacgggcccttaggaccctaggttaccgttaaggtaaaggttatttttacggaaccttttaaagtttttacgtttaaactttcgggttaacctaacggtaccttaaagttaacttaaaacggttaaacccggttgggggttaaccgggtaccgggttttaaccggggaaacccggttaaaacgggggaacccttaaaagggggttaacaaaacgttaccgaaaacgttaacgttgttacgggtctagcctaacgtattctcgttccttaaccg

SEQ ID NO: 442421 - DNA, 706 bp, Homo sapiens
  misc_feature: GZ8MTXP01A9F3F.2.7.A07.1.454.CMB.2.raw
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaagcgccaccctctcctgcagggccagtcagagtatagcagcaacttagcctggtaccagcaagaaaccnggccaggcctcccaggcctcctcatctatcgctgcactcccgaccgacgggccctacgtcggtacctccccgagtccgtacggtttcaggttcgggacgtagggttggggtccgtgggggaacctaggtacgtttctaacgtttccctacgaaccctagtccaagccgtagcccttggacctaggttccgtaagggtaaagttacgttttaggaaccttttaaagttttacttacgttgttaccaaggttactaaagttaatttaaacgttaacggtgggttacgggttaaccggttccggggaaacccgtaaaagggggtaaacccgttaaaggggtaaaacgaaaacgttaaaccgaaaacgggttaaacgttcgggttacgggtaaccttacggaaccctaacccgttagttacccgtttcgtttaacccgtttaacccg

SEQ ID NO: 442422 - DNA, 656 bp, Homo sapiens
  misc_feature: GZ8MTXP01DX0TR.2.7.A07.1.454.CMB.2.raw
  modified_base (647)..(647): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcgagggccagtcagagtattagcagactaacttacgcctaggtaccagcaagaaccgtggaccaggcctcccaggtcctcctacatcctatgctcgacctactccccgaccgaccgggcctaacgttcggtactaccccgaggtccctaggttccgaggtcggcccgtagggttcggggtactgggggaactagggtacgtttcctaactttcgtaccaacccctaagttccgaacgtccgacgtcccttaggtaccgtaggttacctaggtaaacggtttattttagtaacctttaaattttttactttaaccgttgtttacgagtactaaagttattaaagtacgttgggtacgggtacgttcgggaacgtaaagggtacgaaaggtaacgaaatacgaaacgttagttggttcgctagctactattccgttnttcttaacc

SEQ ID NO: 442423 - DNA, 642 bp, Homo sapiens
  misc_feature: GZ8MTXP01A5BBE.2.7.A07.1.454.CMB.2.raw
  modified_base (197)..(197): a, c, t, g, unknown or other
  modified_base (270)..(270): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaagggaancgcccaccctctcctgcgagggccagtcagtagtatagcagactaacttagactggtaccagacaagaaccgnggaccacggcctccgaggtccctcctacatctatcgctgcactcccacgacgggccaacgtcgtactcccgagtcccgtaggttcaggtggacgtggtacgggtctggggactaggtacttcaatttcactaccatcgacgcacgtcctggactagttcgtaggtaacgttagttttacgaacttttaaattttacgttacgttagtaccgtaagtaacttaaaggttaaattaaacgttacgggttacggggttacggtaccggttaaccgggaaccgtaaacgggggtaaaccgttaaaggggtaaacaaaacgttaacgaaaacgttacgttggttacgtgtacaactacacttcgtcgttctttaacg

SEQ ID NO: 442424 - DNA, 639 bp, Homo sapiens
  misc_feature: GZ8MTXP01D7SPP.2.7.A07.1.454.CMB.2.raw
  modified_base (196)..(196): a, c, t, g, unknown or other
  modified_base (210)..(210): a, c, t, g, unknown or other
  modified_base (265)..(265): a, c, t, g, unknown or other
  modified_base (477)..(477): a, c, t, g, unknown or other
  modified_base (623)..(623): a, c, t, g, unknown or other
tcagacgctcgacacacgaccggtgctcgatttagcacgtgtcgcaggggggaggaactgctcagttaggacccagacggaaccatggaagcccagcgcagcttctcttcctcctgctactctggctcccagatgccactggagaagtggtgatgacgcagtctccagccaccctgtctgtgtctccgaggggaancgccaccctctccngcagggccagtcagagtatagcagctaacttcgcctaggtaccagcaacgaaccnggccaggcctacccgaggtccctcctacattcctaagttcgccttgacctaacttccccgaaccggacgggtccctaacgttggtaacctccccgaggtcccgtagggttccagggtcggcgtaggggttcggggtactgggggaactagggtacgtttcagtttccacaccctatcgacgcacgtcctgtacgaggttctaggttaagttnttttacgactttaatttgttacttggtacagtactaagttaagttaagtaacgttgggtacgtaacgttacgaaacgtaaacggggacttaaaggtacgttaaactacgtaaaacgttagttggttaggtctacgtctaaccgttnttcttcgttcttaacg

SEQ ID NO: 442425 - DNA, 601 bp, Homo sapiens
  misc_feature: GZ8MTXP01AVYMN.2.7.A07.1.454.CMB.2.raw
  modified_base (197)..(197): a, c, t, g, unknown or other
  modified_base (264)..(264): a, c, t, g, unknown or other
  modified_base (293)..(293): a, c, t, g, unknown or other
  modified_base (543)..(543): a, c, t, g, unknown or other
  modified_base (571)..(571): a, c, t, g, unknown or other
  modified_base (588)..(588): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttgcctggtaccagcagaaaccnggccaggctcccgaggcctcctcatctangctgcactcccacgagggccctacgtcggtactcccgaggtccctaggttcaggtggccgaggttcggggtctggggacctagggtagtttcaatttcacaaccctattccaggcacggtccctggactagttcagtaaagttcttttggacctttaatttataacgttgtcaaggtcttaagttaaattaaacgtacggttggggtcggtacgttaccgggaccgaaagggtacccttaaaggggttanaaacgttaaccgaaaacgttacgttggnggctagcctaaaccgtnttcgtcgttcctg

SEQ ID NO: 442426 - DNA, 584 bp, Homo sapiens
  misc_feature: GZ8MTXP01CUYJO.2.7.A07.1.454.CMB.2.raw
  modified_base (195)..(195): a, c, t, g, unknown or other
  modified_base (379)..(379): a, c, t, g, unknown or other
  modified_base (396)..(396): a, c, t, g, unknown or other
  modified_base (425)..(425): a, c, t, g, unknown or other
  modified_base (492)..(492): a, c, t, g, unknown or other
  modified_base (569)..(569): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccatggagaagtggtgatgacgcagtctccagccaccctgtctgtgtctccgaggggaanacgccaccctctcctgcgagggccagtcaagagtatagcagcaacttagcctggtaccagcaagaaacctggccaggcctcccgaggtcctcctactatcctagtcgctgcctaactccccgacgacgggcccagttcggactcccgagtccaggttcaggtgcgtagtcggggtctgggaacnggtacgttcattccganaccctatcagtaccagtccagcgtaggtntagggaaacttgtttacgaactttaagttttactacgtttagacctagtactagttataagttacgnggttagacggttcgaacgaaaggggtaccaaagggttaacaacgttaacaagttacgttggacggctacgctacgtnttcgtaacgttctcg

SEQ ID NO: 442427 - DNA, 643 bp, Homo sapiens
  misc_feature: GZ8MTXP01CERF2.2.7.A07.1.454.CMB.2.raw
  modified_base (198)..(198): a, c, t, g, unknown or other
  modified_base (266)..(266): a, c, t, g, unknown or other
  modified_base (397)..(397): a, c, t, g, unknown or other
  modified_base (431)..(431): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagcccacctgtctgtgtctaccgaaggggaaancgcccaccctctcctgcgagggccagtcagagtatagcagctaacgttgctggaccagacaagaaccnggaccacggcctcccgagtcctacctacatctatcgctgccactcccaccgagggcccacgtggtactccgagtccgtaggttcaggtggctaggtcgggtcgtgggactaagggtcttcaattcacactntcagcagcctggacctagttactagtaaagtttntttacgtaactttaaattttacgtacgttacgtaacgaagtaacttaaagttaaacttaaacggttaacggtggggttaaccggtaaccggttaacgggaaaccggtaaaacgggtaaacgttaaaggtaaacgttaaaacgtaaaccgtaaacggttacggttcggaaccgtctactaacccgtacttagttccgttaacgttccttaacg

SEQ ID NO: 442428 - DNA, 666 bp, Homo sapiens
  misc_feature: GZ8MTXP01BY9JC.2.7.A07.1.454.CMB.2.raw
  modified_base (197)..(197): a, c, t, g, unknown or other
  modified_base (212)..(212): a, c, t, g, unknown or other
  modified_base (265)..(265): a, c, t, g, unknown or other
  modified_base (293)..(293): a, c, t, g, unknown or other
  modified_base (493)..(493): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgagggaaancgcccaccctctccngcagggccagtcagagtatgcagcaacttgcctggtaccagcaacgaaaccgnggaccaggcctacccgaggtccctcctnattcctatcgctgccactcccgaccgacgggccctacgtcggtaactccccgaggtcccgtacgggttccagggtcggaccgtaggggttcggggtaccgtgggggaaacctagggtacgtttaccacgttttccacctaaccctataccgaacggcctaacggtcccttaggacccgtaagttccgtaaggtaaagttnttttacgaactttaaagtttttctaaccgttggtaccaaggtactaagttaactaaagtacggttgggtcgggtaccgttacggaccgtaaagggtaacttaaagggtacaaagtacgaaacgttacgttggttacggctcggaacctacgtcttacgttcgttccttaaccg

SEQ ID NO: 442429 - DNA, 849 bp, Homo sapiens
  misc_feature: GZ8MTXP01CRJ2R.2.7.A07.1.454.CMB.2.raw
  modified_base (197)..(197): a, c, t, g, unknown or other
  modified_base (266)..(266): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcgagggccagtcagtagtattgcagcaacttagcctggtaccagacagaaccnggaccacggcctcccgaggtcctccgtcattctatcgctgacctagtccccaccgtacgggcccacgtcggttacctaccccgaggtcccgtacgggtttaccgagggttcgggaccgtagggggttcgggggttaccgtgggggaaacccgtaagggttacggttacctacggtttacctaccgtaacccctagttacccgacggacctacgggtccccttggaaccgttaacggttaccgtttaaagggttaaaacgggttttatttttaacgggtaaaccctttttaaaaggtttttttaactttaacccggtttaggggtttaacctaaacggggttaccttaaaagggtttaaaatttaaaacgggtttaaacccgggttaggggggtttaaccggggttaaccccggggttttaaccggggaaaccccgggttaaaaaagggggtaaccccgggttaaaaagggggttaaacggttaaaacctttaaaccgggaaaaaccggttacggttcgggttaccggtaacggttacggaacccttaacccggtattaccgttccggtttaacctttaacccg

SEQ ID NO: 442430 - DNA, 693 bp, Homo sapiens
  misc_feature: GZ8MTXP01E0CEZ.2.7.A07.1.454.CMB.2.raw
  modified_base (199)..(199): a, c, t, g, unknown or other
  modified_base (311)..(311): a, c, t, g, unknown or other
  modified_base (476)..(476): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctaccgaaggggaaanacgcccaccctctcctgcagggccagtcagagtattagcagactaacttagcctaggtaccagacaagaaaccgtggaccacggcctcccgaggcctcctacatctatcgcncgcctactccccaccgacgggcccacgttcggtacctcccgacggtcccgtaacgggtttcagggttcggacgtaggggttcggggtacgtggggacctaggtacgtttactactttcaccaccgtatcgaacgcgacgccctgacgtagttacgtagtaagttnttttacggaactttaaattttacggttacgttagtaccgtaacgtagttaaagtttaaataaaggtttaaccggttaggggttaacgggtacccgggtttaaccgggaaaccggtaaaagggggtaacccgttaaaaggggtaaacttaaaacgttaaccgaaaacgttacgttggttaacggctacgaaccactacgttctccgtttcttaacccg

SEQ ID NO: 442431 - DNA, 661 bp, Homo sapiens
  misc_feature: GZ8MTXP01DRB3V.2.7.A07.1.454.CMB.2.raw
  modified_base (198)..(198): a, c, t, g, unknown or other
  modified_base (266)..(266): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgcccaccctctcctgcagggccagtcagagtattagcagcaacttagcctggtaccagcagaaccnggccaggctcccaggcctcctcatctatgctgcactcccaccgacgggaccctacgtcggtacctccccgacggcctacgggttccaggtcgggccgtagggttcggggtccgtgggggactaaggtacggtttacacgtttccaccgtaacccaacgtcacggcacggtcccttaggacctagttacgtaggtaaattacttttagactttaaattttacggtttaaacgtcggttacaacggtactaaaggttaacttaaacgttaaacggttgggtacggtaccgggttaccggaaccgtaaaggggaaccaaagggttaacaaaacgtaaacaaacggttaacgttggttacgcgttacaaccgtaactgttaccttcgttccgttaaccg

SEQ ID NO: 442432 - DNA, 690 bp, Homo sapiens
  misc_feature: GZ8MTXP01BW9V9.2.7.A07.1.454.CMB.2.raw
  modified_base (196)..(196): a, c, t, g, unknown or other
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggaanacgccaccctctcctgcgagggccagtcagagtattagcagctaacttgcctggtaccagcagaaccnggcaggcctcccgaggcctcctcatctatcgctgactactccaccgacgggcctacgtcggtactcccgagtccgtacggttcgaggtcggccgtaggtcggggtacctgggggactacgggtacgtttcgtaattcctacaccctatccgaacgtcacgtcccgtgaccgtaggttacctaggtaaaagttcgtttttagaacctttaaagtttttatttacgtacgttaacgacgttataaacgtttaaataaacgttaaaccggttggttaacggggtaaccgtttacccggggaaaccggtaaaaacggggtaacccttaaaaggggttaaaccgaaaacgttaacccgtaaaaacggttaccggttggttaaccggtcgtacgaacctaaaccctgtttacctcgttaacccgtttaaccg

SEQ ID NO: 442433 - DNA, 573 bp, Homo sapiens
  misc_feature: GZ8MTXP01BJ3DZ.2.7.A07.1.454.CMB.2.raw
  modified_base (199)..(199): a, c, t, g, unknown or other
  modified_base (268)..(268): a, c, t, g, unknown or other
  modified_base (299)..(299): a, c, t, g, unknown or other
  modified_base (419)..(419): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagcaacttagcctaggtaccagacaagaaacnggccaggcctccaggctcctcatctatgctncatcccacgagggccaacgtggtactcccagtcctaggttcaggtggactaggtcgggtactggggacagggtattctaatttcacaaccatcaagcagcctgacctagtctaggaattntttcggaacttaatttagttactgtacagtactaataataataagtggtacggtacgttcgggaaccgtaaaggggaaccttaaaaggggtaattaaaataccgaaaaaacgttagttgggagcgtacgaacaacctattctcttcgtttaacc

SEQ ID NO: 442434 - DNA, 623 bp, Homo sapiens
  misc_feature: GZ8MTXP01CWTGW.2.7.A07.1.454.CMB.2.raw
  modified_base (199)..(199): a, c, t, g, unknown or other
  modified_base (297)..(297): a, c, t, g, unknown or other
  modified_base (606)..(606): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanacgcccaccctctcctgcgagggccagtcagtagtatagcagcaacttagcctaggaccagacaagaaacctggaccaggcctcccgaggcctcctanatctatcgctgaccatcccgacgacgggtccaacgtggactcccgagccgtaaggttcaggtggacgtaggtgggtctggggactaagtcgtttacattcaccaactatcgaagcaagtcctgacgtagttactagtaaagttatttagactttaaattttattacgtaggttaccaaacgggtattaaaggtaaacttaaagtaaaccggttgggtaacggtaccgttacggaccgtaaaaggggaaccttaaaggggtaaacaaagtaacgaaaacgttaacgttggttacggctagaaccaacgtnttacgtcgttcttaacc

SEQ ID NO: 442435 - DNA, 812 bp, Homo sapiens
  misc_feature: GZ8MTXP01DJOY7.2.7.A07.1.454.CMB.2.raw
  modified_base (196)..(196): a, c, t, g, unknown or other
  modified_base (268)..(268): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccatggagaagtggtgatgacgcagtctccagccaccctgtctgtgtctccgaggggaaancgccaccctctctgcaggccagtcagagtattagcagactaacttagcctaggtaccagacaagaaacccgnggaccaggcctaccaggcctcctcatcctatcgctcgactactacccaccggacgggtaccctagttacggtactccccgagtccccgtaaggttccgtaaggtcggtcgtacgggttggggtacccgtgggggaactaacgggtaaacgtttccaacgttttcccacaacccctagttaccgaacggtaccgaacggtccccttagggacccttaaggttaccgtaaaggttaaaacgttacgtttttaggtaaacctttaaaaggttttttacgttaacccgtttaggtaaccttaaagggtaacctttaaagtttaaaacccgttaaaaggtttaaccggtttaggggggttaaccgggttaacccggggtttaaccccgggggaaacccggtaaaaaacgggggtaaaccccgttaaaaggggggtttaaaacaaaaccgtttaaacccggaaaaacgggttaacggtttcgggaccgggtaaccggtacgtaacccctaacggttaccttacgggtttaaccgtttcccgttaaccccg

SEQ ID NO: 442436 - DNA, 708 bp, Homo sapiens
  misc_feature: GZ8MTXP01A95X0.2.7.A07.1.454.CMB.2.raw
  modified_base (198)..(198): a, c, t, g, unknown or other
  modified_base (271)..(271): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcagggccagtcagagtatagcagactaacttcgccgtggtacccagcaagaaaccgnggaccaggcctcccgaggtcctcctcatctatcgctcgctactcccaccgacgggccctacgtacggtactcccgacgtccgtaacggttccgaggtcggacgtagggtcgggtcgtggggaactaggttacgttctacgtttccaccgtaacctacgtacacggacgtcgtcccgttggaccttaggttaccgtaggtaaagttacttttaggaacctttaaatttttacggttaacttcggtacctaaggtacctaaaggtttaacttaaacggttaacggttggggttacgggtaaaccggtttccggggaaaccggtaaaacgggggtaaacccgttaaaagggttaacgaaaacgttaaaccggtaaaacgttaccggttggttacgggaacttacggaacctaactacgttaccgttcttccgtttaaccc

SEQ ID NO: 442437 - DNA, 754 bp, Homo sapiens
  misc_feature: GZ8MTXP01AY65C.2.7.A07.1.454.CMB.2.raw
  modified_base (197)..(197): a, c, t, g, unknown or other
  modified_base (265)..(265): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtatagcagcaacttagcctggtaccagcaagaaccgnggaccaggcctcccgaggcctcctcatctatcgctcgccactccccaccgacgggccctacgtcggtaacctcccgagtcccgtaggtttccaggttcggacgtagggttcggggtacgttgggggaacctagggtacgtttcctagtttccctaccgaaccctattaccgaacggtccgaaccggtcccgttaggacccgttaaggtttaccgttaagggtaaaacgtttagtttttacggaaaccttttaaagttttttacgtttaaccgttaggtttaaccaaggttaaaccgttaaagtttaaaacgtttaaagttaaaccgggtttggggttaacgggttaacccgggtttaaccggggaacccgtaaaagggggtaacccttaaaaggggtaaacttaaaacgttaaaccgaaaaacggttaccgttgggttacgggtaactaccggaactaacccgttcttacgttaacgtttaaccgtccg

SEQ ID NO: 442438 - DNA, 649 bp, Homo sapiens
  misc_feature: GZ8MTXP01CVIMJ.2.7.A07.1.454.CMB.2.raw
  modified_base (196)..(196): a, c, t, g, unknown or other
  modified_base (262)..(262): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaangcccaccctctcctgcgagggccagtcagagtatagcagcaacttgctaggtaccagcaagaaccnggaccacggcctcccgaggtccctccctcactctatcgctcgcctactcccgaccgacgggccctacgtcggtacctcccgagtcccgtaggttccaggtcggcgtagggttcggggtctgggggactaggtacgttcagttcctaccacgtactacgacgccagtccctgacgtagttctaaggtaagttacttttgaactttaattttacgttacgttagtacaagtacgtaaagttaaacttaagttaacggttgggtacggtaccggttccggaaccggtaaaggggtaaccgttaaagggtaaaccgaaagtaaaccggaaacgttaacggttggttacggtcgtacgaaccgtaccgtattccgttcgttccgtttaaccg

SEQ ID NO: 442439 - DNA, 726 bp, Homo sapiens
  misc_feature: GZ8MTXP01E2GFE.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcagggccagtcagagtatagcagcaacttgcctaggtaccagacaagaaacctggaccaggcctcccgaggcctcctcatctatcgctcgactactcccgaccgacgggccctaacgttcggtaacctcccgacggtcccgtaaaggggtttccgagggttcggacgtagggggttcgggtacgtgggggaactagggttacgtttcactttccaccaaccctataccgaaggccaaggtccccttaggacccgtagttaccgtaaggtaaacgttatttttacgaaacctttaaaggtttttattaaaccgtggttaccaacgggactttaaagttaaaccgttaaagtttaaaccgggtgggggttaaaccgggtacccgggttaccgggaaacgggttaaaacgggggaacccgtttaaaagggaaacgttaaaacgttaaaccgaaaaccgggttacgtttgggaacggtcctacggaacctaacctagttctaacgttcttaacccg

SEQ ID NO: 442440 - DNA, 681 bp, Homo sapiens
  misc_feature: GZ8MTXP01CJ8ZU.2.7.A07.1.454.CMB.2.raw
  modified_base (197)..(197): a, c, t, g, unknown or other
  modified_base (266)..(266): a, c, t, g, unknown or other
  modified_base (660)..(660): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctccagatgccactggagaagtggtgatgacgcagtctccagccaccctgtctgtgtctccgaggggaaancgcccaccctctcctgcgagggccagtcagagtatagcagcaacttagcctggtaccagcaagaaaccnggtacacggcctcccgaggcctcctcatctatcgctgacactcccaccgacggggtacccacgttcggtaactccccgaggcccgtaagggtttccagggttcggacgtaggggttcgggggttccgtgggggaacctaagggtacgtttcactttcctaccaacctataccgaggcctacggtcccttagaccgtaagttctaaggtaaagttactttttacgaactttaaagtttttacttacgttggttaaccaaggtacttaaaggttattaaagttaacggtgggtacggtaccggttacggacccggtaaaggggtaaccgttaaagggttaaacgaaacgttaaccgaaaacggttacgttggacgggtctacggaacctaacgttnttaccgttcgttaacttaacc

SEQ ID NO: 442441 - DNA, 583 bp, Homo sapiens
  misc_feature: GZ8MTXP01D65QW.2.7.A07.1.454.CMB.2.raw
  modified_base (196)..(196): a, c, t, g, unknown or other
  modified_base (294)..(294): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcgagggccagtcagagtattagcagactaacttacgcctaggtaccagcaagaaacctggccaggcctccgaggcctcctanatctagtgctcgacactccacgacggccacgtcgtactcccgagccgtaggtcaggtcgcgtaggtcgggtctggggactaggtacgttcagttcctacactactcagcactccgtgactagtctagtattagtttcgaacttaagtttcttaacgtgttaacattacgaattagtaaagtacgtggtacgtacgttcggaaccgtaaagggtaacaagggtacaaacgtaaacggaaacgttcgttggacggctaacggccaacgtgttcttcgttaactttaacccg

SEQ ID NO: 442442 - DNA, 571 bp, Homo sapiens
  misc_feature: GZ8MTXP01D213E.2.7.A07.1.454.CMB.2.raw
  modified_base (196)..(196): a, c, t, g, unknown or other
  modified_base (544)..(544): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatgcagcaattagcctggtaccagcaagaacctggccaggcctacccgaggcctcctacatcctatgctgcaatcccacgcgggccacgtggtactcccgagcccgtaggttcaggtggcgtaggtcggggtctgggggactggtaacgttcacgtttctcgacctatcgacggcacggcccttgacctagttctagtagttattttgacttaattttagttacttgtacctagtctaagtaattaagtacgttgggtcgtacgttcggcgaaagggtaccgaaagggtaacaaagtacgaaaacgttacgttggnggctagctactattctcgttcgttaac

SEQ ID NO: 442443 - DNA, 579 bp, Homo sapiens
  misc_feature: GZ8MTXP01BDIY9.2.7.A07.1.454.CMB.2.raw
  modified_base (198)..(198): a, c, t, g, unknown or other
  modified_base (265)..(265): a, c, t, g, unknown or other
  modified_base (289)..(289): a, c, t, g, unknown or other
  modified_base (365)..(365): a, c, t, g, unknown or other
  modified_base (424)..(424): a, c, t, g, unknown or other
  modified_base (561)..(561): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangcccaccctctcctgcgagggccagtcagagtatagcagcaacttagcctggtaccagcaagaaccnggccaggcctcccgaggctccctnatctatcgctgcactcccgaccgagggcccagtcggtactcccgaagcctaggttcaggtcggcaggttcggggtntggggacaggtagtttcagtttccacacctatcaagcacgcctgcagttctagaagttnttttgactttaatttagttactggtacagtataagtattaagtacgtgggtacgtaccggttacggaccaaaagggaaccttaaaggtaaacaaagttaccgaaaacgttacgttgggttacgctcggaacctaacntttctcgttaaccttccg

SEQ ID NO: 442444 - DNA, 741 bp, Homo sapiens
  misc_feature: GZ8MTXP01ET2I5.2.7.A07.1.454.CMB.2.raw
  modified_base (197)..(197): a, c, t, g, unknown or other
  modified_base (211)..(211): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtcgtctccgaagggaancgccaccctctccngcacgggccagtcagtagtatagcagctaacttcgcctggtaacccagacaacgaaaccgtcggaccacgggcctaccccgaggtccctcctacacttctagtcgccttcgactactaccccgaccgacggggtccctacgtcggtaacctccccgaggtcccgtagggtttccgagggtcggctaggggttcggggtcgtaagggggacctaagggttacgtttctaactttccgacctaacccgtactacgacggtccaacggtcctaggacctaggttcgtaagtaaagtttacgttttacgaacctttaattttacgttacgttagtaccgtaagtacgttaaaagttaacgtttaaacgtaaaggttcggggttacggtaaccggtttaccgggaaaccggtaaaacggggtaacccgttaaaagggtaaaccggttaaaactaaaccggtaaaaaccggttacgttcgggttacggcctacggtaaccctaacctacgttaccgtttccggttttaacctcccg

SEQ ID NO: 442445 - DNA, 603 bp, Homo sapiens
  misc_feature: GZ8MTXP01D0T8X.2.7.A07.1.454.CMB.2.raw
  modified_base (195)..(195): a, c, t, g, unknown or other
  modified_base (265)..(265): a, c, t, g, unknown or other
  modified_base (288)..(288): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctcccagatgccactggagaagtggtgatgacgcagtctccagccaccctgtctgtgtctccgaggggaanacgccaccctctcctgcgagggccagtcaagagtatagcagctaacttgcctggtaccagcaagaaaccnggccaggcctaccgagcctcctnatctatgctgaccactcccgacgacgggccctagtcgtacctccgagcccgtaggttcaggtcggacgtagggttcgggtactggggaactagggtacgtttcaagtttccgactaaccagtccaaggccacgcctagacgtagtctagtaagttatttagactttaattttacgtacttgtacaagtctaaagtactaaagttacgtgggtacgtacggttaccggacggtaaaggggacttaaagggtaattaaacgacgaaacgttacgttgggacgaactcgaactaacctgttacgttcttcgtttaacc

SEQ ID NO: 442446 - DNA, 605 bp, Homo sapiens
  misc_feature: GZ8MTXP01APIVI.2.7.A07.1.454.CMB.2.raw
  modified_base (197)..(197): a, c, t, g, unknown or other
  modified_base (206)..(206): a, c, t, g, unknown or other
  modified_base (210)..(210): a, c, t, g, unknown or other
  modified_base (263)..(263): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (288)..(289): a, c, t, g, unknown or other
  modified_base (313)..(313): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaaggggaaangccaccctntccngcagggccagtcagagtattagcagcaaacttgcctggtaccagcagaaaccnggccaggctccaggcnctnatntannctgcactccacgaggcacgtgacnccagcctacgttcagtcggctaggtgggtctgggacagtacgttacatttcacaacctatcacgacgacgccgtacgacgtacgtacgtagtaagttaacgtttacgttacgttaactttaacgtttaacttacgttacgtacgtacgtaagtaattaaacgttaaacgttaggttacggtacggttcggtaccgaacggaaccggttaaacggtaaacgttaaacgtaaacgtaaaacgttaacgttacgttacggaacgtacgaacgacctacttacttcgttcgttaac

SEQ ID NO: 442447 - DNA, 637 bp, Homo sapiens
  misc_feature: GZ8MTXP01D3P06.2.7.A07.1.454.CMB.2.raw
  modified_base (197)..(197): a, c, t, g, unknown or other
  modified_base (329)..(329): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcaggccagtcagagtatagcagcaacttgcctggtaccagcaagaaacctggccaggacctcccgaggcctcctcatctatgctgcatccaccgagggccctacgtggttaacccnccgacgtccgtacggttcgaggtcggcgtagggtcgggtcgtgggactaggtacgtctacttactacacatacacgcacgtctgacgtacgtacgtagtaagttactttacgtaactttaattttacgttacgttagtactagtactaagttaagttaaacgttacggtggtacgggtaaccggttacggaaacggtaaacggggtaaccgaaaggttaaagttaaacgtaaaccgtaaaacggttacgttcgggttacggtaacgacgtaaccgtaccgtacgttacgttaacgttaacgttaaccg

SEQ ID NO: 442448 - DNA, 601 bp, Homo sapiens
  misc_feature: GZ8MTXP01DIGA9.2.7.A07.1.454.CMB.2.raw
  modified_base (199)..(199): a, c, t, g, unknown or other
  modified_base (265)..(265): a, c, t, g, unknown or other
  modified_base (282)..(282): a, c, t, g, unknown or other
  modified_base (288)..(288): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcagggccagtcagagtatagcagcaacttgcctaggtaccagcaagaacngcaggctccgagctccnatctangctgcactcccacgaggccagtgtactcccgagccgtaggttcaggtggctaggtcgggtctggggactaggtacgttcacttcacaccagtccagcacgcctggactagtctagtaagttatttacgactttaattttacgttacgtacggttacaaggtacttaaaggttaataaacgtttacggtgggttaccggtaaccggttacggaacccggtaaagggtaaccttaaaggggtaaacaaacgtaacggaaacgttacgttggttacggttaacactaacctagtcgtttactcctttcgtaacccg

SEQ ID NO: 442449 - DNA, 639 bp, Homo sapiens
  misc_feature: GZ8MTXP01AINC0.2.7.A07.1.454.CMB.2.raw
  modified_base (196)..(196): a, c, t, g, unknown or other
  modified_base (265)..(265): a, c, t, g, unknown or other
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagtccaccctctcctgcaggccagtcagagtatagcagcaacttagcctggtaccagacagaaacccgnggccacggcctcccgaggtccctccgtcatctatcgctgcactcccaccgcgggccctagtcggtactacccgagccctaggttcgaggtcggcgtaggtcggggtcgtcgggactaggtagttctacgtttacncctaaccatcgacgcgacgtcctgactacgttacgtagtaagttattttgaactttaagttttaattacgttagtacctaagtacgtaagttaacgttaagtacggtgggtaccggtaacgggttaccgggaacgtaaacggggaaccgttaaagggtaaacgaaacgtaaaccgtaaacggaaacgttgggttacggtcgttacgaaccaccgttacttcgttcgttccgttaacccg

SEQ ID NO: 442450 - DNA, 576 bp, Homo sapiens
  misc_feature: GZ8MTXP01ANIHX.2.7.A07.1.454.CMB.2.raw
  modified_base (200)..(200): a, c, t, g, unknown or other
  modified_base (210)..(210): a, c, t, g, unknown or other
  modified_base (292)..(292): a, c, t, g, unknown or other
  modified_base (385)..(385): a, c, t, g, unknown or other
  modified_base (395)..(395): a, c, t, g, unknown or other
  modified_base (421)..(421): a, c, t, g, unknown or other
tcagacgctcgacacacgaccggtgctcgatttagcacgtgtcgcaggggggaggaactgctcagttaggacccagacggaaccatggaaggccccagcgcagcttctcttcctcctgctactctggctcccagatcgccactggagaagtggtgatgacgcagtctccagccaccctgtctgtgtctccgaggggaaancgccaccctntcctgcagggccagtcagagtattagcagctaacttgcctggtaccagcagaaacctggccaggcctcccgaggcctccgtnatcctatcgctgcactcccacgacgggccctagtcggtactcccagtcctaggttcagtgcctaggtcgggtctgggacaagtcgttcattcnacccagtcanccagccctgaccagtctaggaatttnttacgtattaagtttagttacgtgtacagtactaagtaactaagtacggtggtaccggtacgtaccggaacgaacggtaacgttaaaggtaacaaacgtaacgaaacgttcggttgttacgaactacgaacctactacgttcctcgttcctaacg

SEQ ID NO: 442451 - DNA, 628 bp, Homo sapiens
  misc_feature: GZ8MTXP01BXIK9.2.7.A07.1.454.CMB.2.raw
  modified_base (198)..(198): a, c, t, g, unknown or other
  modified_base (208)..(208): a, c, t, g, unknown or other
  modified_base (263)..(263): a, c, t, g, unknown or other
  modified_base (285)..(285): a, c, t, g, unknown or other
  modified_base (614)..(614): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctntcctgcagggccagtcagagtatagcagcaacttagcctggtaccagcagaaccnggccaggcctccaggcctcctnatctatcgctgcactcccaccggagggccctaacgtggtactccccgaggtcctaaggttcaggttgggacctagggtcggggtctgggggaaactaggggatttccaatttccacaaccctatcgaaggcaggtccctggacctagtccgtagtaaagttgttttacgactttaatttttacggtacttggtacctaggtactaaagtactaaagttaacggtggttaacgggtaccggttaggaaccgtaaagggggaacccttaaaggggtaaacttaaacgtacgaaaacggttaacgttggacggtaacctggaacttaacctnttcgtcgttccttc

SEQ ID NO: 442452 - DNA, 685 bp, Homo sapiens
  misc_feature: GZ8MTXP01C4MK4.2.7.A07.1.454.CMB.2.raw
  modified_base (196)..(196): a, c, t, g, unknown or other
  modified_base (271)..(271): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgagggaanacgccaccctctcctgcagggccagtcagagtatagcagctaaacttcgcctaggtacccagcgaagaaacccgnggacccaggcctcccgacggtccttcccctacacttaccttatcggccttcgacctaactccccgaacccggacggggacccctacgttacgggtaccctccccgagcccgttaacggtttcgacggtggtaccgtaggggttcgggtcgtaagggggacctaagggttacgttctaacgttctaccaaccctaattccgaacgcgaacggtcccttaggacccgtagttaccgtaagtaaggttatttaggacttaaatttttacgtacgttgtaacacggtataaagtaagtaataaccggttgggtaccgtacggttaccggaacgtaaacgggaccttaaaagggtaacgaaactaaacgtaacgaagttggttacgtctacgaactacctagttctttcgttcttaacc

SEQ ID NO: 442453 - DNA, 834 bp, Homo sapiens
  misc_feature: GZ8MTXP01EZ11U.2.7.A07.1.454.CMB.2.raw
  modified_base (264)..(264): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaagacgccaccctctcctgcacgggccagccagagtatagcagcaattagcctaggtaccagcaagaaccngccaggctcccaggcctcctcatctatgctgcatccccacgacgggccctacgtggtaacctcccgacgtcccgtacgggtttccaggtcgggtacgtacggggttcggggtccgttgggggtaaacccaaggtacgggttttacccaagtttttccccgaccgtaacccctattacccgtaacgggcccttaacggcccccgttggaaccccgtaggtttacccgtaacgggtttaaaacgggttattttttaacggttaccctttaaaacgtttttttaagtttaaacccgttttcggggttaccctaaagggttaacccttaaaagggttttaaaactttaaaagtttaaaacccgggtttgggggtttaaccgggttaacccgggtttaccgggggaaccccgtaaaaaacggggggtaaccttaaaaaaccgggggtaaattaaaaaaccgtttaaaccgggaaaaaaaccggttaaccggtttggggttaacgggttaacccgggttacgaaacccgtaccttaaacggtttcctttaaccggttttaacccgttttaaccccg

SEQ ID NO: 442454 - DNA, 736 bp, Homo sapiens
  misc_feature: GZ8MTXP01ETMN1.2.7.A07.1.454.CMB.2.raw
  modified_base (195)..(195): a, c, t, g, unknown or other
  modified_base (264)..(264): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaggggaancgccaccctctcctgcacgggccagtcagtagtatagcagcaacgttagcctggtaccagcaagaaccnggaccaggcctcccgaggtcctcctcatcctatcgctcgcactcccacgacgggcctacgttcggtactcccgagtccgtacggttcaggtggcgtagggttcgggtacgtggggaactaggtacgtttcactttccncaaaccgtactacgacggtccgtacggtcctagggaaccttacggttacctaaggttaacgttactttttaacgggaacttttaaaactttttacgggttaactttcggtaaccgtaacgggttacctaaaaggttaacctttaaaaggttaaaccgggtttcgggggttaacggttaaacccggggtttacccggggaaaccggttaaaacgggggtaacccggttaaaaggggttaaacgttaaaccgttaaaccggaaaacggttaaccgttgggttaggaacccgtaggtaacccctaacgtagttacccgtttctttccgtttaacccg

SEQ ID NO: 442455 - DNA, 596 bp, Homo sapiens
  misc_feature: GZ8MTXP01C919Q.2.7.A07.1.454.CMB.2.raw
  modified_base (198)..(198): a, c, t, g, unknown or other
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaaggggaanacgccaccctctcctgcagggccagtcagatatagcagcaattgcctggtaccagcaagaacctggaccaggcctcccgaggcctcctnatctatgctgcatccacgagggccactgactccagcctagtcagtgctaggtcgggtctggggactaggtacgttcacgttctacacctatacgagcaggtccctaggactaggttctaggtaagttatttgaactttaattttacgtaactgttacagtactaagttaataacgttaaggtggtaggtaccgttaccggaacgtaaaacggggtacaaaggggttaacaaaacgttaaccgaaacgggttaacgttggttaacgggtccttagcccgtaacctagttccgttaacgttcctttaaccg

SEQ ID NO: 442456 - DNA, 716 bp, Homo sapiens
  misc_feature: GZ8MTXP01AZIN2.2.7.A07.1.454.CMB.2.raw
  modified_base (199)..(199): a, c, t, g, unknown or other
  modified_base (497)..(497): a, c, t, g, unknown or other
  modified_base (693)..(693): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaacncgcccaccctctccgtgcgagggccagtcagtagtattagcagactaactacgcctaggtaccagacaagaaccgtggaccaggtcctacccgaggcctcctactattctatcgctacgaccactcccgaccggacgggtaccctacgttacggtacctccccgaggtaccgtaacggttcagggtcggacgtagggggttcggggttacgtaacgggggactaacgggtacgttacctacgtttcccacctaccgtatcgaacgcctagccctagacctaggttacaggtaaacttntttacgactttaaagtttattaaccgttgtaaccgtagtaacgttaagtttaaacgttaacgtttaaacgggtcggggttaaacgggtacccggtttaaccgggaaacccggtaaagggggtaaacccttaaaggggttaaacgaaacccgttaaaggaaacggttacgttggttacggaacttccgaactacgtnttaccggttcgttaacgtaaccc

SEQ ID NO: 442457 - DNA, 574 bp, Homo sapiens
  misc_feature: GZ8MTXP01E0HXZ.2.7.A07.1.454.CMB.2.raw
  modified_base (198)..(198): a, c, t, g, unknown or other
  modified_base (267)..(267): a, c, t, g, unknown or other
  modified_base (398)..(398): a, c, t, g, unknown or other
  modified_base (567)..(567): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtgggtgatgacgcagtctccagccaccctgtctgtgtctccgagggaaanacgcccaccctctcctgcagggccagtcagagtatagcagcaacttagcctggtaccagcaagaaaccnggccaggctcccaggctcctcatctatgctgccactcccgaccgaggggccctagtggttacctccccgaagccctaggttccaggtggccagggtggggtcctggggaaccagggtacgtttcatttccncaccctatccagcgagccctgacctagttctaggtaaagttacttttgacttaattttacgtcttagtcagtactaagttataaagttactggggtgtacggttccggacgaaacgggcaaagggtacgaaatacgaaacgacgttggttacggctgccactattcgtnttccttc

SEQ ID NO: 442458 - DNA, 759 bp, Homo sapiens
  misc_feature: GZ8MTXP01DF597.2.7.A07.1.454.CMB.2.raw
  modified_base (195)..(195): a, c, t, g, unknown or other
  modified_base (268)..(268): a, c, t, g, unknown or other
  modified_base (297)..(297): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccatggagaagtggtgatgacgcagtctccagccaccctgtctgtgtctccgaaggggaanacgcccaccctctcctgccgagggccagtcagagtatagcagcaacttagcctggtaccagacaagaaaccgnggaccacggcctacccgaggcctccctanactctatgctgccactcccgaccgtacgggccctacgtaggttacctcccgaagtccccgtaaggtttccaggttcgggaccgtagggtttcggggtccgtgggggaactacgggtaagttttccaacggttttcccaccaacccgttaagtcctaacggtccaacggtcccctaggaccttagggtttacctaagggttaaattacgtttttaagaccttttaaatttttattaccgttaggtacctaaaggtaacttaaggttaaactttaagttaaacgggttcgggttagggtaaacccgggtttaccgggaaaccggtaaaaacgggggtaaccttaaaacgggggtttaaaaacaaaacgttaaaccggtaaaacggttacggttcgggttacgggtaacccgttaacgtaacccgttaaccgttacgtttacccgtttaaccgtttccttaaccg

SEQ ID NO: 442459 - DNA, 575 bp, Homo sapiens
  misc_feature: GZ8MTXP01AH4FK.2.7.A07.1.454.CMB.2.raw
  modified_base (372)..(372): a, c, t, g, unknown or other
  modified_base (401)..(401): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccgaggcctcctcatctatgctgcatcccacgagggcccatggtactcccagcctaggttccaggtgcaggtgggtctggggacaggtagttcattcncacatcagcagcctgcagtctagaagttntttagactttaatttacgttactgttacagtactaagttaataaagttaacgtgggtacggtacggttaccgggaacggtaaagggaaccgttaaagggtaaacgaaacgtaacgaaaacgttacgttggttacggtctacggaacctaaccgtacgttcgttcgttcttaacg

SEQ ID NO: 442460 - DNA, 553 bp, Homo sapiens
  misc_feature: GZ8MTXP01AJ1X5.2.7.A07.1.454.CMB.2.raw
  modified_base (197)..(197): a, c, t, g, unknown or other
  modified_base (264)..(264): a, c, t, g, unknown or other
  modified_base (363)..(363): a, c, t, g, unknown or other
  modified_base (392)..(392): a, c, t, g, unknown or other
  modified_base (424)..(424): a, c, t, g, unknown or other
  modified_base (485)..(485): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagcaattagcctggtaccagcagaaaccnggccaggctccaggctctcatcatgctgcatccacgagggccacgtggtactccagcctaaggttcagtggcaggtgggtctgggacagagttcattcncaccatcagcagcctgcagtctagaagtntttgaacttaaatttagttactggttcaagtntaagtaataaagtaacgtgggtagtaccggttcggaacgtaaagggaaccaaagggtaaanaaactaaaccgaaaacggttaacgttgacgggaacttacggctaaacccgttgttcttcgttcctaac

SEQ ID NO: 442461 - DNA, 680 bp, Homo sapiens
  misc_feature: GZ8MTXP01DWYJY.2.7.A07.1.454.CMB.2.raw
  modified_base (192)..(192): a, c, t, g, unknown or other
  modified_base (201)..(201): a, c, t, g, unknown or other
  modified_base (261)..(261): a, c, t, g, unknown or other
  modified_base (660)..(660): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccatggagaagtggtgatgacgcagtctccagccacctgtctgtgtctcgagggaancgccacctntcctgcgagggccagtcagagtatagcagacaacttagcctaggtaccagcaacgaacgnggccaggcctcccgaggtcctcctacatacctatcggctcgacctactccccgaccgacgggccctaagtcggtacctacccgagccgtaggttccaggtggtccgtagggtcgggtcgtcggggactagggtacgttctaacgttcacgtaacctactcgacgtacgacgtccgtagtaccgtagttacgtaaggtaagttactttacgaaacttttaacgttttaggttaacgtgtaaccgtaagtacgttaaaggtaacttaaacggttaaacggttggggttaacggtaccgggttaacggaaacccgggtaaaggggtaaaccttaaaggggtaaacgttaaacgtaaacggtaaaaccggttagttacggttcggtaactacggaacctactnttacgtcgtttcttaacccg

SEQ ID NO: 442462 - DNA, 607 bp, Homo sapiens
  misc_feature: GZ8MTXP01DKWEE.2.7.A07.1.454.CMB.2.raw
  modified_base (198)..(198): a, c, t, g, unknown or other
  modified_base (552)..(552): a, c, t, g, unknown or other
  modified_base (580)..(580): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtcgtctacgaaggggaaancgcccacctctctgcgagggccagtcagtagtattagcagactaacgttgccgtaggtaccagacaacgaaaccgtcggaccacggcctacccgacggtcctaccgtacacttctagtcgctcgacctactacccgacgacgggtccacgttcgtacctccgagtcccgtaggttcaggtcgcgtacgggtgggtacgtgggactaggtacttactactttcacacgtatccaagcgacgtctacgactacgtacgtaaggtaatttatttactaacttaaattttacttaacgtgtactaagtactaagtactaagtacgtggtacgacgtacgacgtaaaggacaaagtaanaaacgtacgaaacgttgttggcgtaacncgaactacctattcttcgttcttaacc

SEQ ID NO: 442463 - DNA, 607 bp, Homo sapiens
  misc_feature: GZ8MTXP01C3YUZ.2.7.A07.1.454.CMB.2.raw
  modified_base (197)..(197): a, c, t, g, unknown or other
  modified_base (264)..(264): a, c, t, g, unknown or other
  modified_base (327)..(327): a, c, t, g, unknown or other
  modified_base (331)..(331): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccacctctcctgcgaggccagtcagagtatagcagctaacttagcctggtaccagcagaaaccnggacccaggcctcccaggcctcctcatctatgctgcactcccaccgagggcccacgtggtacncccngtcctaggttcaggtggctaggtcgggtctgggactaggtagttcatttcctacgacctatcagtcacgtcctagcctaggtcctaggtaaattgtttgacctttaaattttacgtcctttaggtacagtacgtaagttaacttaagtacgttggtacgggtaccgttccggaaccgtaaacggggtaaacccttaaggggttaaacaaacgttaacgaaacggttacgttgggacgtctacggtccaaccgtacttcttaacgttctttaacccg

SEQ ID NO: 442464 - DNA, 624 bp, Homo sapiens
  misc_feature: GZ8MTXP01ETLPL.2.7.A07.1.454.CMB.2.raw
  modified_base (195)..(195): a, c, t, g, unknown or other
  modified_base (505)..(505): a, c, t, g, unknown or other
  modified_base (595)..(595): a, c, t, g, unknown or other
  modified_base (602)..(602): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatcgccactggagaagtggtgatgacgcagtctccagccacctgtctgtgtctcgaagggaancgccaccctctcctgcgacgggccagtcagtagtatagcagctaactgctgaccagacaacgaaaccgtggaccacggcctacccgaggtcctacctacgtatcctatcgtctagcctactcccgacgtacgggcctacgtcggtacctcccgacggtcctaggttccgaggtcggacgacggggttcgggtacgtcgggggaaactagggtacgtttctacgttcctacacgacttcgacgtctacgtcctgaccgtagttcctaaggtaactttgtttacgaactttaattttacgtaacgttcgtanaacgttataagttaactaagttacggtggtacggtacgtcggaacgaaggaacttaaggaaacttaagtacgtaaacttcgttgttacgntagaacncttattcgtaacttaacgtccc

SEQ ID NO: 442465 - DNA, 560 bp, Homo sapiens
  misc_feature: GZ8MTXP01EY4KA.2.7.A07.1.454.CMB.2.raw
  modified_base (197)..(197): a, c, t, g, unknown or other
  modified_base (419)..(419): a, c, t, g, unknown or other
tcagacgctcgacacacgaccggtgctcgatttagcacgtgtcgcaggggggaggaactgctcagttaggacccagacggaaccatggaagcccagcgcagcttctcttcctcctgctactctggctcccagatgccactggagaagtggtgatgacgcagtctccagccaccctgtctgtgtctccgaggggaaancgccaccctctcctgcagggccagtcagagtatagcagctaacttagcctggtaccagacaagaaacctggaccaggcctacccgaggcctcctcatctatgctgcactccacgacgggcctagtgtactccgagccgtaggttcaggtggctaggtcgggtctggggactaggtacgttcacttcacacctatcagcacgcctgactagttcaggtaattntttagacttaatttctacgtgtacagtactaagtaattaagtacggtggtacggtacgttcggacgaaagggtaccaaagggtaacaaagtacgaaaacgttagttgttaggctgaaccacgtattcttaacgttctaacg

SEQ ID NO: 442466 - DNA, 574 bp, Homo sapiens
  misc_feature: GZ8MTXP01BFEW2.2.7.A07.1.454.CMB.2.raw
  modified_base (197)..(197): a, c, t, g, unknown or other
  modified_base (262)..(262): a, c, t, g, unknown or other
  modified_base (285)..(285): a, c, t, g, unknown or other
  modified_base (442)..(442): a, c, t, g, unknown or other
  modified_base (529)..(529): a, c, t, g, unknown or other
  modified_base (561)..(561): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcgagggccagtcagagtatagcagcaacttgcctggtaccagcagaaccnggccaggcctccgaggcctcctnatctatgctgcactcccaccgacgggccctagtcggtactccccgagtcccgaaggttccgaggttcggccgtaggttcggggtcgtgggggactagggtacgtttccaagtttccacgacctatcgagcacgtcctgacgtagtctaagtaagttnttttagacttaatttacgtactggtactagtctaagtactaagtaacgtgggtaggtacgttcggacgtaagggaacttaggtaaanaaagtacgaaacgagttgagggctcgcacctnttacctgttctcg

SEQ ID NO: 442467 - DNA, 822 bp, Homo sapiens
  misc_feature: GZ8MTXP01ATAAZ.2.7.A07.1.454.CMB.2.raw
  modified_base (199)..(199): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctctgcagggccagtcagagtatagcagacaacttagcctaggtaccagacaacgaaacctggaccaaggcctacccgaaggtccctaccctacaattcctaagtcgacttacgacctaactaccccgaacccgaacgggggaccccctaacggttacggttaaccctaccccggaagacccccggttaagggtttaccgaaaggttcggggaccgtaagggtcggggtaacccgttgggggaactagggtacgtttactacgttttaccaccaacccgtataccgaaggtacctacgggacccttaggacccgtaacgggtttactaagggtaaacgtttaagttttacgaccttttaaaatttttaacgtttaacccgttgggttaacaaccggtattaaaaggtttaaacttaaaagggttaaaccgggttagggtaacggggtttaaccgggtttaaccggaaacccgggttaaaaacggggaaaccggttaaaagggtttaaaacgaaaacgttaaaaccggaaaaaacggttaaccggttaggttacgggttaacctaacggaacccttaaacacggtttcccttaaggttaacccgttttaacccg

SEQ ID NO: 442468 - DNA, 539 bp, Homo sapiens
  misc_feature: GZ8MTXP01AN04I.2.7.A07.1.454.CMB.2.raw
  modified_base (197)..(197): a, c, t, g, unknown or other
  modified_base (263)..(263): a, c, t, g, unknown or other
  modified_base (282)..(282): a, c, t, g, unknown or other
  modified_base (285)..(285): a, c, t, g, unknown or other
  modified_base (341)..(341): a, c, t, g, unknown or other
  modified_base (401)..(401): a, c, t, g, unknown or other
  modified_base (415)..(415): a, c, t, g, unknown or other
  modified_base (504)..(504): a, c, t, g, unknown or other
  modified_base (514)..(514): a, c, t, g, unknown or other
  modified_base (530)..(530): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaaccngaccaggctccaggctccnatntatgctgcatcccacgagggccacgtgtactcccaggcctaggttcaggtcggacnggtgggtctgggacagtgtctagttctacacccatcagcagcctagctagtctagtagtntttgacttaatttntaacttgtacagtacagtaactaatacgtggtacgtaccggttcggaactaaacgggaacttaaagggtaacaaagttaacgaaaaccngttgttcggntacgcactattcgttnttaacttcc

SEQ ID NO: 442469 - DNA, 650 bp, Homo sapiens
  misc_feature: GZ8MTXP01CD6BV.2.7.A07.1.454.CMB.2.raw
  modified_base (196)..(196): a, c, t, g, unknown or other
  modified_base (262)..(262): a, c, t, g, unknown or other
  modified_base (592)..(592): a, c, t, g, unknown or other
  modified_base (623)..(623): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctccagatgccactggagaagtggtgatgacgcagtctccagccacctgtctgtgtctccgaagggaaancgcccacctctcctgcgaggccagtcagtagtatagcagctaactgcctggtacagactaagaacnggccacggcctcccgaggtccctcctactagtcctagtcgctcgacctactaccccgaaccgaccggggtaccctacgttccggttacctaccccgacgtaccgtaacgggtttccgaacggggttcggacggtaaggggttcggggtaccggtggggacctaaggtacggttcaacgtttcctacaacttcaccgtacggctaacgtcctacgtaccgtaggtcctaaggtaagtttcttaacgtactttaagttttactagtacgtacaggtactaagtaactaagttgtggtacggtacgtacgcggtaaacggacttaaaggaaanaacgtaacggaacttacgttggttcaacgtnaaccgacgtattcctcgttcttaaccg

SEQ ID NO: 442470 - DNA, 957 bp, Homo sapiens
  misc_feature: GZ8MTXP01CQTWS.2.7.A07.1.454.CMB.2.raw
  modified_base (197)..(197): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctccagatgccactggagaagtggtgatgacgcagtctccagccaccctgtctgtgtctccgaaggggaancgcccaccctctcctgcgacgggccagtcaagtagtattagcagcaacgttcgcctaggtaccagacgaacgaaacctcggaccacggtcctacccgaggtccctacctctatctatggcctcgacctactccccgaaccggacgggaccctacgttacggtacctacccggacgtaccgtacgggtttaccgagggtcgggtaccgtaagggggttccgggggttacgggtaacggggggtaaccgttaaacgggttaaccggggttttacccgttaacgttttaccccgtaaccccaaaccccggttaacgttaacccgggaaccgttaaccccggaaaccggggttaccccttcggggttaaaccccgttaaggggtttaacccgttaaacggggtttaaacggttttaaatttttaccggttaaaccttttaaaacggtttttttaactttaaaccggtttcggggtttaacttaaaacggggttaaccctttaaaacggtttaaaacgtttaaaaacgggtttaacccggggttagggggtttaaaccggggttaaccccggggttttaaacccgggggaaacccgggtaaaaaacggggggttaaaaccccgttaaaagggggttaaaacggaaaacccgtttaaaaaccggaaaccgggttaaaccgggttgggggttaacccgtaaccggtacggtaaccctaaaccccggtttagtttacccgtttaaccggttttaaccctttttcccgg

SEQ ID NO: 442471 - DNA, 924 bp, Homo sapiens
  misc_feature: GZ8MTXP01EN6N0.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctaccgagggaaancgccaccctctccgtgcgagggccagtcagagtatagcagactaacttacgccgtaggtaacccagacgaaacggtaaaccctcgggacccgaacgggtccctaccccgaacgggtccccttacccctactaactttccgtaacgttcggcctttacggaccctaaccttaccccgaaccccgggaacccgggggtaccctaaccggttcggggtttaaacccctaccccccgaaacgggtacccccgttaaccgggggtttaccggtacggggttacggggtacccggtaagggggttcggggggttaaccgtttaacgggggggaaacctaaacggggttaccgggttttacccgtaaactttttaccccggtacccaaacccgtattaccggaaccggtaccaaccgggttcccgtaggtaacccggtaaggtttaccgtaaggttaaacgtttacgttttaggtaaaccttttaaaatttttacggtttaaaccgttgggtttaaaccacggttactaaacgtttaaagtttaaaacgtttaacggggttaacggggttaacggggttaaccgggtttaacccggggaaacccgggtaaaaggggtaaacccgttaaaagggtttaaacggaaaacttaaccggtaaaaaccggttaggttacggttacggggtaacttaacgggaacctaacgtaacgttaccgtttcgttccgtttaacccg

SEQ ID NO: 442472 - DNA, 682 bp, Homo sapiens
  misc_feature: GZ8MTXP01EBVJS.2.7.A07.1.454.CMB.2.raw
  modified_base (199)..(199): a, c, t, g, unknown or other
tcagacgctcgacacacgaccggtgctcgatttagcacgtgtcgcagggggaggaactgctcagttaggacccagacggaagcatggaagccccagcgcagcttctcttcctcctgctactctggctccagatgccactggagaagtggtgatgacgcagtctccagcccacctgtctgtcgtctaccgaaggggaacncgcccaccctctcctgcgaggccagtacagtagtatagctagactaacttagcctaggtacagacaacgaaaccgtcggaccaggcctaccgaggtcctctcatctatcgctcgactaccgtaccgaccgacggtcctacgttcgtaacctcccgacggtaccccgtagggtttacagggtcggacgtaacggggttcgggtccggagggtaactagggtactttctaacgttctaccacctataccgagacacggtcctaggactagtacgtagtaaacttagtttactaactttaagttttacgttaccgtgttaacgaagtaactaagttaaattaaacgtaacggtcgggttacggtaaccgggttaacggaacggtaaacgggttaaaccgtaaagggttaaactaaacttaacggaaaaacggttcgttaggaacggtacgtaacgtaacctaccttagttccctttaaggtttccc

SEQ ID NO: 442473 - DNA, 657 bp, Homo sapiens
  misc_feature: GZ8MTXP01DQRFO.2.7.A07.1.454.CMB.2.raw
  modified_base (191)..(191): a, c, t, g, unknown or other
  modified_base (278)..(278): a, c, t, g, unknown or other
  modified_base (463)..(463): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccatggagagtggtgatgacgcagtctccagccacctgtctgtgtctcgagggaancgccacctctctgcgaggccagtcagatatagcagctaattcgcctaggtaccagcaaagaacctggccaggcctccgagcctcctnatctatcgctgacaacgttcccaaccggacgggtccctacgttcggtaacctcccggagtcccgtaaggttccgaggtagggtcgtaggttcggggtacgtgggggactagggtactttcaactttcgtaccacacgttcgactcgacggtccttagacgttagtacgttagaacgttagttttntaactttaattttaacgtttacgttgggttaaaccacggtaattaagttattaaacggttaacgtggggttaacggtacgttaccgggaaccggtaaaaggaaccgttaaagggttaaacaaacgttacgaaaacgttcgttacggttacgtaacgttcgaacctacgtacgttcttaacgttccgtttaaccg

SEQ ID NO: 442474 - DNA, 721 bp, Homo sapiens
  misc_feature: GZ8MTXP01AS3S2.2.7.A07.1.454.CMB.2.raw
  modified_base (199)..(199): a, c, t, g, unknown or other
  modified_base (263)..(263): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtcctgtgtctccgaaggggaaanacgcccaccctctcctgcgagggccagtcagagtatagcagcaattgcctggaccagcagaacnggcagctccagctctcatctatgctgcactccgacgacgggccctacgtggtaactcccgaggtcccgtaaggtttcagggtcggtcgaacgggttcggggtacgtcgggggaaactaggtaaggtttcccaacgtttcccacctaaacccacgttaccgaacggacctacggtcccgtacgtaccgtacggttagtaaccgggtaaaggtttacctttttaagggaccttttaaaaggtttttaacttaccgggttacgtaccctaaaggtaccttaaagttaaacgttaaacgttaaacgggttcggggttaccggtaaccggtttaccggggaaacccggtaaaacggggtaaccgttaaaaggggttaaacaaaccggtttaaacgaaaacgggttaccgttggttcgggtaaccttcggaactacccgtagttaccctcggtttcttaacccg

SEQ ID NO: 442475 - DNA, 628 bp, Homo sapiens
  misc_feature: GZ8MTXP01DTNDO.2.7.A07.1.454.CMB.2.raw
  modified_base (198)..(198): a, c, t, g, unknown or other
  modified_base (294)..(294): a, c, t, g, unknown or other
  modified_base (574)..(574): a, c, t, g, unknown or other
  modified_base (612)..(612): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagccaccctgtctgtcgtctccgaggggaanacgccacctctcctgcagggccagtcagagtattagcagcaaacttcgcctggtaccagcaagaacctggaccaggcctacccgaggccttcctanacttctagtcgactcgacctaactccccgaaccgacggggtcccacgttcggtactaccccgagccccgtaggttccaggtcggaccgtaggtcggggtactgggggaactagggtaactttcgaactttcctacgaacctacgtcgaagtccgaaggcccttagaccgtagttctaaggtaattactttacgaatttaacttttattaacgttggttaacagtacaagttaataagtaacgtggtacggtacgtacgacgaaagggtacaaagggtaanaaactacgaaacgttaagttggttaacgctagctaacncttctcgttaacttcc

SEQ ID NO: 442476 - DNA, 665 bp, Homo sapiens
  misc_feature: GZ8MTXP01BNCCR.2.7.A07.1.454.CMB.2.raw
  modified_base (195)..(195): a, c, t, g, unknown or other
  modified_base (260)..(260): a, c, t, g, unknown or other
  modified_base (503)..(503): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaancgccaccctctcctgcgaggccagtcagatatagcagcaacttgcctggtacagacaagaaccgnggaccaggcctacccgaggtcctcctacacgttcctagtcgcgttacgaccctacgttccccgaaccggaccggggtccctaacgtacggttaacctccccgaaacggtccgtacggtttccgagggttcggtccgtaggggttcggggtacgttcgggggaaacctagggttacgttaccttaacgtttccctaccaaacccgtacttacgacgtaccgacggtccctaggacgtacggttntaggttaaacttgtttagaacctttaattttacgtatgtacagttactaagttaactaagtacggttggtcggtacgtacgggaccgtaaaggtaccgaaagggtattaaagacgtaaagttacgttggttacgcagtcacctagttctaacgttcttaacc

SEQ ID NO: 442477 - DNA, 715 bp, Homo sapiens
  misc_feature: GZ8MTXP01E04PZ.2.7.A07.1.454.CMB.2.raw
  modified_base (200)..(200): a, c, t, g, unknown or other
tcagacgctcgacacacgaccggtgctcgatttagcacgtgtcgcaggggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaanacgcccaccctctcctgcagggccagtcagagtatagcagactaacttagcctaggtaccagacagaaccctggccacggtcctcccgagggtccctcctcaattcctatttacggcccttaggaccctaaccgtaccccgaaccccggaagggggtccccctaacggttaccggttaaacctcccccgaaaggtccccgtaagggttccaggtacgggtcgacgggttcgggtcgtaaggggctagggactttcatttccaccaaccgtatacgacgtccacggtcctaggaccgttacggttactaagttacgttactttacgtaaccttaatttaccgttacgttcgtacgtaggtaactaacgttagtaacggtacgggtagtaccgggtacgtaaccgggaagaaaccgggtaaacgttaaagaaccggttaaaacaaccggtaaccgttacgttcgttaccggaacaccgtcctaccgtactttaccttaaccgttaacctttaacccg

SEQ ID NO: 442478 - DNA, 678 bp, Homo sapiens
  misc_feature: GZ8MTXP01DE9QW.2.7.A07.1.454.CMB.2.raw
  modified_base (195)..(195): a, c, t, g, unknown or other
  modified_base (425)..(425): a, c, t, g, unknown or other
  modified_base (434)..(434): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaanacgccaccctctcctgcgaggccagtcagagtatagcagctaacgtacgcctggtaccagcaagaaaccgtggaccaggcctacccaggcctcctacatctatcgctgaccactcccgacgacgggcctaacgtcggtacctcccgaacgtccgtaggttccaggtggaccgtagggttcggggtacgttgggggactaggtaccggtttctaacgtttccacgtaaccntccggaacncgacgtcctagtactagttctaaggttaagttagtttactaatttaacgttttacgttacgttagtacctagtataaagttacgttaaaggtacggttggttaccgggtaaccggtaccgggaaaccggtaaacggggtaacgttaaagggttaaacgttaaaaccgtaacggtaaaacggttagttcgggttacgtaacgtcgtaaccctacgttagttccgtttaaccggttaaccttaacg

SEQ ID NO: 442479 - DNA, 602 bp, Homo sapiens
  misc_feature: GZ8MTXP01A6ILO.2.7.A07.1.454.CMB.2.raw
  modified_base (195)..(195): a, c, t, g, unknown or other
  modified_base (207)..(207): a, c, t, g, unknown or other
  modified_base (265)..(265): a, c, t, g, unknown or other
  modified_base (334)..(334): a, c, t, g, unknown or other
  modified_base (448)..(448): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctcccagatgccatggagaagtggtgatgacgcagtctccagccaccctgtctgtgtctccgaaggggaanacgcccaccctntcctgcagggccagtcagtagtatagcagactaacttgcctggtaccagcaagaaccnggaccaggcctaccgagcctccgtcactctatcgctgacactcccgacgagggtcccagtacggtaccnccgagtaccgtacggttcgaggtcggcgtagggtcggtcgtaaggggactagggtacttcatttcccgataccgtatccgaagtccgaggcctgtactagtctagtaaagtttntttagactttaagttagttacgtgtacagtatagtaattaagtacggtggtacgtacgtacggaacgtaaaggtaacaaaggtaaacaaacgtaaacgtaaaaggttcgttggaccgtaactacgtcctaacgttcttcgttaacttcgtaacc

SEQ ID NO: 442480 - DNA, 514 bp, Homo sapiens
  misc_feature: GZ8MTXP02IHSZV.2.7.A07.1.454.CMB.2.raw
  modified_base (360)..(360): a, c, t, g, unknown or other
  modified_base (388)..(388): a, c, t, g, unknown or other
  modified_base (464)..(464): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggatcccagccaggttcagtgcagtgggtctggggacagagttcattcncaccatcagcagcctgcagtctgaagtntttgactaaatttattactgtacagctagtaataataactggtagacgttcggaccaaagggacctaaagggtaanaaagtacgaaaacgaactggtaggaactagaccaccatcctagttacttc

SEQ ID NO: 442481 - DNA, 544 bp, Homo sapiens
  misc_feature: GZ8MTXP02HOUA6.2.7.A07.1.454.CMB.2.raw
  modified_base (368)..(368): a, c, t, g, unknown or other
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagcctggtaccagcaagaaacctggccaggcctcccaggcctcctcatctatgctgcatcccaccgagggcccactggtactccccagccaggtcagtgcaggtggtctggggacaggtagttcattcncaccatcagcagcctgcagtctagaagtatttgacttaaattttattacttgtactagactagtaataataaacgtgggtaggtacggttcggaccgtaaaggggaccgtaaaggtaacgaaaactacaaaacgtaacgtggtaggaactaggactaccagttcctgttacttacg

SEQ ID NO: 442482 - DNA, 536 bp, Homo sapiens
  misc_feature: GZ8MTXP02IZEC9.2.7.A07.1.454.CMB.2.raw
  modified_base (362)..(362): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtgcagtgggtctggggacagagttcattcncaccatcagcagcctgcagtctgaagtatttgacttaatttattacttgtacagtacagtataatacgtggtaggtacgttcggacgtaaacgggacctaaaagggtacgaaaacgttacgaaaaccgtaacgtggtacggaactcggaccaccgattcgtacgttactttacc

SEQ ID NO: 442483 - DNA, 536 bp, Homo sapiens
  misc_feature: GZ8MTXP02HXY7K.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactccccagccaggttcagtggcagtgggtctggggacaggtgttccattctcacccatcagcagcctgcagtctgaagtatttgacttaatttattacttgtcagtcagtataataacgtggtaggtacgttcggacgtaaagggaccgtaaagggtaacgaaagtacgaaaacgtacgtaggtacggtaactaggacctaccgattccttacgttctacc

SEQ ID NO: 442484 - DNA, 503 bp, Homo sapiens
  misc_feature: GZ8MTXP02F4AQB.2.7.A07.1.454.CMB.2.raw
  modified_base (493)..(493): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggccactggtatcccagccaggttcagtggcagtgggtctggggacaggagttcattctcaccatcagcagcctgcagtctgaagatttgactaaatttattactgtcagcagtataataactggtgacgttcggaccaaagggaccaaaggtagaaaatacaaaacgaaactgtaggaactgacaaccntctactactc

SEQ ID NO: 442485 - DNA, 502 bp, Homo sapiens
  misc_feature: GZ8MTXP02IWOI0.2.7.A07.1.454.CMB.2.raw
  modified_base (347)..(347): a, c, t, g, unknown or other
  modified_base (356)..(356): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagcccaggttcagtggcaggtgggtcnggggacagngttcattcncaccatcagcagcctgcagtctagaagtatttgactaattttattactgtcagcagtataatactggtgacgttgaccaaagggacaaaggtagaaatacgaaacgaactgtaggctgacacgatacctgttacttc

SEQ ID NO: 442486 - DNA, 574 bp, Homo sapiens
  misc_feature: GZ8MTXP02HVXR5.2.7.A07.1.454.CMB.2.raw
  modified_base (199)..(199): a, c, t, g, unknown or other
  modified_base (373)..(373): a, c, t, g, unknown or other
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaancgcccaccctctcctgcgagggccagtcagatatagcagcaattgcctggaccagcaagaacctgccagctccaggcctctcatctatgctgcatccaccgagggcccagtggtaactcccagcctaggtcagtggctaggtggtctggggacaggtcgttcatttccacaacntcagcagcctgcagtctagaaagttntttagactttaatttattacgtgtacagtactaagttaataaagttaacgttgggtacggtaccggttacggaacgtaaacggggaaaccgtaaaaggtaaacaaaacgttaaccgaaaacgtacgttaggtacggtaacgtacgaacctacgtagttccgttacgtttactacg

SEQ ID NO: 442487 - DNA, 573 bp, Homo sapiens
  misc_feature: GZ8MTXP02HTXAI.2.7.A07.1.454.CMB.2.raw
  modified_base (196)..(196): a, c, t, g, unknown or other
  modified_base (276)..(276): a, c, t, g, unknown or other
  modified_base (281)..(281): a, c, t, g, unknown or other
  modified_base (288)..(289): a, c, t, g, unknown or other
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtatagcagcaacttagcctggaccagcagaaacctggccaggctccagcnctcanctatgcnnatccacacggccactgtactccacgcacgtcagtgcgagtggtcgtggacgagtagttctattctcaccactacagacacgctcgcgagtcgtagtaagtagtttagtactaaatttaatttacttagtacgtacgacgtaagtaaattaaaattaaaacgtaggtaggtacggttacggtaaccggtaaacgggaaaaccggtaaacggtaaacgtaaaacgtaaaacgtaaaacgaaacgtaacgtacggtaacgtacgacaccaactacttacgttacttc

SEQ ID NO: 442488 - DNA, 540 bp, Homo sapiens
  misc_feature: GZ8MTXP02HFSS9.2.7.A07.1.454.CMB.2.raw
  modified_base (364)..(364): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggccactggtactcccagccaggttcagtgcaggtgggtctggggacagagttcattcncaccatcagcagcctgcagtctagaagtatttgacttaattttattacttgtcagtactaagttataattaacgtggtaggtacgttcggaccgtaaacggggacctaaagggtacgaaaagtacgaaaacgtaacgtaggtaggaactacggacctacctatctacgttacttac

SEQ ID NO: 442489 - DNA, 548 bp, Homo sapiens
  misc_feature: GZ8MTXP02GKDLG.2.7.A07.1.454.CMB.2.raw
  modified_base (318)..(318): a, c, t, g, unknown or other
  modified_base (361)..(361): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggccactggtacncccagccaggtcagtgcagtggtctggggacagtgttcattcncacctatcagcacgcctgcagtctagaagttatttgacttaaattttattacttgtactagactaagtaataattacgtgggtaggtacgttcggaaccgtaagggaaccgtaaaggtaacgtaaaactacgaaaacgtaacgttaggtacggcgttacgaccacctattccgtacgtttacttacg

SEQ ID NO: 442490 - DNA, 574 bp, Homo sapiens
  misc_feature: GZ8MTXP02G7HN1.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcaagaaacctggccaggctcccaggcctcctcatctatgctgcatcccaccacgggccactggtactccccagccaggttcagtggcaggtgggtctggggacaggacgttcattctacaccatcagcacgcctgctagtctagaagtatttgacttaaattttacttacgttgtactagtactaagttaattaaagtaacgtgggttacggtaacgtttcgggaccgtaaaacggggaccgtaaaagggtaacgaaaattaccgaaaacgtaacgtggtacggaactcggacctaacctagttccttagttctttaccg

SEQ ID NO: 442491 - DNA, 531 bp, Homo sapiens
  misc_feature: GZ8MTXP02HBKSD.2.7.A07.1.454.CMB.2.raw
  modified_base (369)..(369): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccaggcctcctcatctatgctgcatcccacgagggccacgtggtactccccagccaggttcagtgcaggtgggtctggggacagagttcattcncaccatcagcagcctgcagtctagaagtatttgacttaattttatactgtcagactaagttaataataacgtggtaggtacgttcggaccgtaaaggggacctaaaggtaacgaaaactacgaaaacgaactggacggctagacacgtatcctagtacttac

SEQ ID NO: 442492 - DNA, 518 bp, Homo sapiens
  misc_feature: GZ8MTXP02GXGPW.2.7.A07.1.454.CMB.2.raw
  modified_base (439)..(439): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggcccactggtactccccagccaggttcagtgcagtgggtctggggacaggagttcattctcaccatcagcagcctgcagtctagaagtattttgactaattttattactgtcagcaagtataaataacgtggnggtacgttcggacgaaacgggaccaaaggtagaaaatcgaaaacgactgtagctaggaccaccgtatctacgtacttcc

SEQ ID NO: 442493 - DNA, 496 bp, Homo sapiens
  misc_feature: GZ8MTXP02F3XUL.2.7.A07.1.454.CMB.2.raw
  modified_base (359)..(359): a, c, t, g, unknown or other
  modified_base (457)..(457): a, c, t, g, unknown or other
  modified_base (473)..(473): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatcatgctgcatccacagggccactggactcccagccaggttcagtggcagtgggctggggacagagttcattcnaccatcagcagccctgcagtctgaagtatttgactaaatttatactgtcagcaagtataataactggtgacgttcggactaaaggggaccaaaggtanaaatacaaaacgaacngtaggctagcacatctgtcttac

SEQ ID NO: 442494 - DNA, 492 bp, Homo sapiens
  misc_feature: GZ8MTXP02I5GXQ.2.7.A07.1.454.CMB.2.raw
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggctcctcatctatgctgcatccacagggccactggtatccccagccaggttcagtggcagtgggctggggacaggagttcattctcaccatcagcagcctgcagtctgaagtatttgactaatttatactgtcagcagtataataactggtgacgtggaccaaagggaccaaaggtagaaatcaaacgaactgtaggctgcaccatctgtacttc

SEQ ID NO: 442495 - DNA, 486 bp, Homo sapiens
  misc_feature: GZ8MTXP02GNVY2.2.7.A07.1.454.CMB.2.raw
  modified_base (197)..(197): a, c, t, g, unknown or other
  modified_base (363)..(363): a, c, t, g, unknown or other
  modified_base (453)..(453): a, c, t, g, unknown or other
  modified_base (470)..(470): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaaacctggccaggctcccaggctcctcatctatgctgcatccaccagggccactggtactcccagccaggttcagtgcagtgggtctggggacagagttcattcncaccatcagcagcctgcagtctgaagatttgactaatttattactgtcagcatataataatagtgagtcgcgaacggacgaagtagaaanaacaacgaactagtagngcgacacatctctctc

SEQ ID NO: 442496 - DNA, 526 bp, Homo sapiens
  misc_feature: GZ8MTXP02IBKXI.2.7.A07.1.454.CMB.2.raw
  modified_base (197)..(197): a, c, t, g, unknown or other
  modified_base (358)..(358): a, c, t, g, unknown or other
  modified_base (471)..(471): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaaacctggccaggctcccaggctcctcatctatgctgcatccacagggccactgactcccagccaggttcagtgcagtggtctgggacagagttcattcncaccatcagcacgccctgcagtctagaagtatttgacttaatttattacttgtacagtctaagtataaatacgtggtagtacgttcggactaaacgggaaccgtaagggtaanaaaacgtacgaaaacgacttagtaggaacgtgaccaccattcgtcgttacttacg

SEQ ID NO: 442497 - DNA, 525 bp, Homo sapiens
  misc_feature: GZ8MTXP02JLYPP.2.7.A07.1.454.CMB.2.raw
  modified_base (197)..(197): a, c, t, g, unknown or other
  modified_base (367)..(367): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggctcccaggcctcctcatctatgctgcatccaccagggccatggtactccccagccaggttcagtgcaggtggtctggggacaggtagttcatttcncaccatcagcagcctgcagtctagaagtattttgacttaatttattactgtcagtctagtataaataacgtggtaggtacgttcgaccgaaaggggaccaaagggtacgaaaataccgaaaagtaacgtgtaggctagaccacgatctacgtcttacg

SEQ ID NO: 442498 - DNA, 534 bp, Homo sapiens
  misc_feature: GZ8MTXP02G8WEW.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtatagcagcaacttagcctggtaccagcagaaacctggccaggctcccaggctcctcatctatgctgcatccacagggccactggtactcccagccaggttcagtgcaggtgggtctggggactaggagttcattccacgacctatcagcacgccctgacagtctagtaagtatttgacttaattttactacgtgtactagtacaagttataataacgtggtagtacgtcgacgaacggacgtaaaggtaacgaaactacgaaacgtactaggtacggaactacggacacgtactcgtcgttcttac

SEQ ID NO: 442499 - DNA, 497 bp, Homo sapiens
  misc_feature: GZ8MTXP02IER1B.2.7.A07.1.454.CMB.2.raw
  modified_base (197)..(197): a, c, t, g, unknown or other
  modified_base (359)..(359): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtatagcagcaacttagcctggtaccagcagaaacctggccaggctcccaggctcctcatctatgctgcatccacagggccatggtactcccagccaggttcagtgcagtggtctggggacagagttcattcncaccatcagcagcctgcagtctagaagtattttgacttaaattttattacttgtcagtcagtataatactggtgacgttcggactaaagggacaaggtacaaatacaaacgactgtagctgacacgtatctagtcttc

SEQ ID NO: 442500 - DNA, 513 bp, Homo sapiens
  misc_feature: GZ8MTXP02I4BGP.2.7.A07.1.454.CMB.2.raw
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggccactggtatccccagccaggttcagtggcaggtcgggtctgggggacaggagttcattcncaccatcagcagcctgcagtctgaagtatttgactaatttattacttgtacagtactagtataatacgtggtggtacgttcggactaacgggaccaaaggtacgaaaatacgaaaacgaactggtaggctgacaccatctgtcttac

SEQ ID NO: 442501 - DNA, 559 bp, Homo sapiens
  misc_feature: GZ8MTXP02G8VRB.2.7.A07.1.454.CMB.2.raw
  modified_base (398)..(398): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagcctggtaccagcaagaaacctggccaggcctcccaggcctcctcatctatgctgcatcccaccagggccactggtactccccagccaggttcaggtggcaggtgggtctggggacagagttcattcacaccatcagcagcctgcagtctagaagtntttgacttaatttattactgtacagtacaagttaataaagtaacgtgggtacggtaacgttcgggacccgtaaaaggggtaccaaagggttaacgaaaacgttacgaaaacggtaacctggtacggcgtacgacctacctattcccttggttacctttacg

SEQ ID NO: 442502 - DNA, 514 bp, Homo sapiens
  misc_feature: GZ8MTXP02I361N.2.7.A07.1.454.CMB.2.raw
  modified_base (363)..(363): a, c, t, g, unknown or other
  modified_base (391)..(391): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggccatggtactccccagccaggttcagtgcagtggtctggggacagagttcatttcnaccatcagcagcctgcagtctagaagtnttttgactaaattttatactgtacagtcagtataataactggtagtacgttacggaccaaagggacctaaagggtaacgaaaagtacaaaacgaactggtagcgtagacacatctgtacttac

SEQ ID NO: 442503 - DNA, 584 bp, Homo sapiens
  misc_feature: GZ8MTXP02G7T1O.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccgacgggcccacgtcggtaactccccgaggcccagggtttccaggtcggcgtaggtggggtctgggggacaggtagttcattcctcaccctatcagcagcctgcagtctgaagtatttgacttaatttatactgtactagtactaagttaataacgttaacgtgggttacggtacggtttaccgggaccgtaaaacgggggaccctaaagggtaaacgtaaaacgtaccaaaacggtaaccttggtaaggcctaggaccaccgtagtcgtacgtctttaccg

SEQ ID NO: 442504 - DNA, 577 bp, Homo sapiens
  misc_feature: GZ8MTXP02HFY4R.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccacctctcctgcagggccagtcagagtattagcagcaacttagcctggtaccagcaagaaacctggccaggcctcccaggcctcctcatctatgctgcatccaccgaggggccacgtggtaactccccgagcctaggttcaggtggactaggttcggggtctgggggaactaggtacgttcatttcgacacctatcagcagcctgcagtcagaagtatttgacttaattttatacgttgtacagactaagttataagttaacgtggtacggtacgttcggaacccgtaaaggggtacctaaagggtaacgtaaaactaccgaaaaacgtacgttggtacggaactacggaccaactagttccttacggtactttaccg

SEQ ID NO: 442505 - DNA, 577 bp, Homo sapiens
  misc_feature: GZ8MTXP02H5Z6A.2.7.A07.1.454.CMB.2.raw
  modified_base (196)..(196): a, c, t, g, unknown or other
  modified_base (281)..(281): a, c, t, g, unknown or other
  modified_base (365)..(365): a, c, t, g, unknown or other
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctctgcagggccagtcagagtatagcagcaacttagcctggtaccagcagaaacctggccaggctcccaggctcctnatctatgctgcatccaccagggcccatggtactccccagccaggttcagtggctagtgggtctgggggacaggtagttcattcncaccatcagcagccctgactagtctagaaagttntttagacttaaattttacttacttgtacagtactaagttaaataaacgttaacgtgggttacggtacgttacggaaccgtaaaacgggtaacgtaaaagggtaaacgaaaacgtaacgaaaacgtaacgttaggtacggtaacgtacgaaccactacgttacgttacgttaccttacg

SEQ ID NO: 442506 - DNA, 539 bp, Homo sapiens
  misc_feature: GZ8MTXP02G6YV7.2.7.A07.1.454.CMB.2.raw
  modified_base (196)..(196): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttgcctggtaccagcagaaacctggccaggctcccaggctcctcatctatgctgcatccacagggctacgtggtactcccagccaggttcagtggcaggtgggtctggggacagagtttcatttcncacatcagcagccctgcagtctagaagtattttgacttaattttattacttgtacagtactagtaattaataacgtgggtacggtacggtttcggaccgtaaaggggaccaaagggtaacaaaagtacgaaaacgtaacgtggtacggctacgactaccattctacgtctttac

SEQ ID NO: 442507 - DNA, 504 bp, Homo sapiens
  misc_feature: GZ8MTXP02HIEVA.2.7.A07.1.454.CMB.2.raw
  modified_base (200)..(200): a, c, t, g, unknown or other
  modified_base (315)..(315): a, c, t, g, unknown or other
  modified_base (340)..(340): a, c, t, g, unknown or other
  modified_base (348)..(348): a, c, t, g, unknown or other
  modified_base (357)..(357): a, c, t, g, unknown or other
  modified_base (390)..(390): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaaanagccaccctctcctgcagggccagtcagagtattagcagcaacttagcctggaccagcaagaaacctggccaggcctcccagctcctcatctatgctgcatccacaggccatgancccagccaggtcagtgcagtggtcngggacagngttcattcncaccatcagcagcctgcagtctagaaatatttnattaatttatactgacagatagtaataaataagtaggtaggtacgtacgacgaacggaacgaaagtaaagaaataaacaaacgaacgtagtagcgacgacacactactctactc

SEQ ID NO: 442508 - DNA, 569 bp, Homo sapiens
  misc_feature: GZ8MTXP02HMHTT.2.7.A07.1.454.CMB.2.raw
  modified_base (418)..(418): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatcccaccagggcccacgtggtactcccagccaggttcagtggcaggtcgggtctgggggacaggacgttcattctcacccatcagtcagcctgcagtctagaagtatttgactaaattttntacttgtcagtctaagttataaattaacgtggtaggtacgttcggaccgtaaaggggaacctaaagggtaaacgaaaacgtaacgaaaacgtaaccgttaggtacgggtaactacggaccgtaacccagttcccttagtttacctttaccg

SEQ ID NO: 442509 - DNA, 679 bp, Homo sapiens
  misc_feature: GZ8MTXP02JGG9X.2.7.A07.1.454.CMB.2.raw
  modified_base (199)..(199): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaagngcccaccctctcctgcagggccagtcagagtatagcagcaacttgcctggaccagcagaacctgccaggctccaggcctcctcatctatgctgccatccccaaccgacgggccctacgtcggtactccccgagtccctaagggtttcaaggttcggaccgtagggttcggggttaccgtgggggaacctagggtacggtttccaagttttcccaccaaccctaagtccaaacggtccaacggtcccttagacgtacggttacttaaggtaaagttatttttaggaacctttaaatttttactaacgtttgtacctaaggtacttaaaggttaacttaaagttaacgggttagggtacggttaaccggttacgggaacccgttaaaagggggaaacctaaaaggggttaaacaaaacgttaacgaaaaccggtaacgttgtacgggcctacggacctacctattcctacgttacttacccg

SEQ ID NO: 442510 - DNA, 509 bp, Homo sapiens
  misc_feature: GZ8MTXP02FQGDI.2.7.A07.1.454.CMB.2.raw
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggcccactggtactcccagccaggttcagtggcagtgggtctggggacaggagttcattcncaccatcagcagcctgcagtctagaagtatttgacttaatttattactgttcagcaagtataataactggtagacgttcggactaagggaccaaaggtacgaaatacgaaacgtaactgtacggctgacacatctacgtcttac

SEQ ID NO: 442511 - DNA, 551 bp, Homo sapiens
  misc_feature: GZ8MTXP02IYHEQ.2.7.A07.1.454.CMB.2.raw
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggctcctcatctatgctgcatccaccagggcccactggtactccccagccaggttcagtgcagtgggctggggacagagttcatttcncaccatcagcagcctgcagtctgaagtatttgactaaattttattacttgtcagtactaagttactaaattacgtgggtaggtaccgttcggaccgtaaacggggacctaaaaggggtaagaaaactacgaaaacgtaacgtaggtaggaacgtacgacaacccgtataccgttagtactttaccg

SEQ ID NO: 442512 - DNA, 523 bp, Homo sapiens
  misc_feature: GZ8MTXP02IQUER.2.7.A07.1.454.CMB.2.raw
  modified_base (196)..(196): a, c, t, g, unknown or other
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccactggtatccccagccaggttcagtggcaggtgggtctggggacaggtagttcattcncacatcagcagcctgcagtctagaagtatttgactaaattttatacttgtacagacaagttataaataacgtggtaggtacgttcggacgtaaagggaccaaagggtaacgaaaatacgaaaacgtaactggagctacgacaccatctgttacttac

SEQ ID NO: 442513 - DNA, 518 bp, Homo sapiens
  misc_feature: GZ8MTXP02GSGIX.2.7.A07.1.454.CMB.2.raw
  modified_base (196)..(196): a, c, t, g, unknown or other
  modified_base (361)..(361): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccactggtatcccagccaggttcagtgcagtgggtctggggacagagttcattcncaccatcagcagcctgcagtctagaagtatttgactaatttatacttgtacagtctaagttataaatacgtggttagacgttcggactaaagggaccaaaggtacgaaacgtacgaaaacgtacgtggtacggctagaccactatctacgtcttacg

SEQ ID NO: 442514 - DNA, 518 bp, Homo sapiens
  misc_feature: GZ8MTXP02GLZ9R.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtgcagtgggtctggggacaggagttcattctcaccatcagcagcctgcagtctgaagtattttgacttaatttattactgtcagcagtataataacgtggtaggtacgttcggaccgtaaaggggaccaaagggttaagaaaactacgaaaacgaactgtaggctacggacaccatctcgtctttac

SEQ ID NO: 442515 - DNA, 522 bp, Homo sapiens
  misc_feature: GZ8MTXP02HRTA0.2.7.A07.1.454.CMB.2.raw
  modified_base (197)..(197): a, c, t, g, unknown or other
  modified_base (399)..(399): a, c, t, g, unknown or other
  modified_base (414)..(414): a, c, t, g, unknown or other
  modified_base (498)..(498): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaacctggccaggcctcccaggcctcctcatctatgctgcatccaccagggcccactggtactcccagccaggttcaggtgcaggtgggtctggggacagtagttcattccacaccatcagcagcctgctagtctagaagtntttgacttaaatttnttactgcagctaagttaataatacgtggtaggtacgttacggacgtaagggactaaagggtaacaaataacgaaaacgactagnggaactgacacatcctagttctac

SEQ ID NO: 442516 - DNA, 667 bp, Homo sapiens
  misc_feature: GZ8MTXP02FZAZ7.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctccaggctcctcatctatgctgcatcccacagggccacgttcggtacctccgacgccgtacgtacgaggtcgacgtagggtcgggttcggtcggggactaggtacgttacctatttccaccactatccgagccgacgtccgtagacgtacgttcgtaaggtaagtttagtttcgtaaacttttaaatttactttaacgttcgtacgtaacggtattaaagttaaattaaaacgttacggttaggggttacggtaacccgggttaccgggaaaccggtaaaacggggtaaaccggttaaaagggggtaaaactaaaacgtaaacggtaaaaccggttaagtcgggtaacggtaacttacggacctaaacgttcttacggttacgttactttaacccg

SEQ ID NO: 442517 - DNA, 518 bp, Homo sapiens
  misc_feature: GZ8MTXP02F30ZD.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatccaccagggcccatggtactcccagccaggttcagtggcaggtgggtctggggacaggagttcattctcaccatcagcagcctgcagtctgaagtatttgacttaaatttattactgtcagctaagtataataacgtggtaggacgttcggaccaaagggaccaaaggtaacgaaaatacgaaaacgaaactgtacggctagacaccatctacgtcttac

SEQ ID NO: 442518 - DNA, 501 bp, Homo sapiens
  misc_feature: GZ8MTXP02F8FPQ.2.7.A07.1.454.CMB.2.raw
  modified_base (357)..(357): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctgccaggctcccaggctcctcatctatgctgcatccacagggccatggatcccagccaggttcagtgcagtgggtctggggacagagttcattcncaccatcagcagcctgcagtctagaagtatttgactaatttattactgtcagcagtataataacgtggtgacgttcggacctaaaggggaccaaagggtacaaaagtacaaaacgaactgtaggctagacacatctgtctttac

SEQ ID NO: 442519 - DNA, 529 bp, Homo sapiens
  misc_feature: GZ8MTXP02HU3B1.2.7.A07.1.454.CMB.2.raw
  modified_base (283)..(283): a, c, t, g, unknown or other
  modified_base (335)..(335): a, c, t, g, unknown or other
  modified_base (355)..(355): a, c, t, g, unknown or other
  modified_base (360)..(360): a, c, t, g, unknown or other
  modified_base (465)..(465): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctccnatctatgctgcatccacagggccatgtatcccagccaggtcagtgcagtggntggggacagagttcagttcncaccntacagcagcctgacacgtctagaagtatttgacttaatttattactgtacagactaagtactaataacgtggtagtacgttcggacgtaacgggaccaaaggtanaaaacttacgaaaacgtaaacgtggtacggaactacggactaccaattcctagttactttaccg

SEQ ID NO: 442520 - DNA, 578 bp, Homo sapiens
  misc_feature: GZ8MTXP02HIH41.2.7.A07.1.454.CMB.2.raw
  modified_base (195)..(195): a, c, t, g, unknown or other
  modified_base (431)..(431): a, c, t, g, unknown or other
  modified_base (462)..(462): a, c, t, g, unknown or other
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccacctctcctgcagggccagtcagagtatagcagcaacttagcctggtaccagcagaaacctggccaggcctccgaggctcctcatctatgctgacactcccaaccgaggggcccaacgttggtaactcccccgaagcccaacgggtttccaggttgggacctagggtggggtctgggggaacaggtagtttccaatttcacaacccatcgagcagcctgcagtctagaagtntttgacttaatttatactgtcagcaagttanaataacgtggtaggtacgttcggaaccaaaggggacctaaagggtaaacgaaaacgttaacaaaaacgtacgttaggacgggaactacggacctaaccgattccgtagttcttacc

SEQ ID NO: 442521 - DNA, 564 bp, Homo sapiens
  misc_feature: GZ8MTXP02H70R4.2.7.A07.1.454.CMB.2.raw
  modified_base (198)..(198): a, c, t, g, unknown or other
  modified_base (366)..(366): a, c, t, g, unknown or other
  modified_base (396)..(396): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtatagcagcaacttagcctggtaccagcagaaacctggccaggctcccaggctcctcatctatgctgcatccacagggccatggtactccccagccaggttcagtggcaggtggggtctggggacagtagttcattcncacatcagcagcctgacagtctgaaagttntttgacttaaattttattacgtgtacagtactaagttaataaattaacgtgggttacggtacgttacgggaaccgaaagggaaccgtaaagggtaaacgaaaacgtaacgaaaacggtaactggtacgtaacgtacgaacctaccgtattccgttacgtttaccttcg

SEQ ID NO: 442522 - DNA, 545 bp, Homo sapiens
  misc_feature: GZ8MTXP02JHA4G.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggcccatggtactccccagccaggttcagtcggcaggtgggtctgggggacaggtagttcattcgtacaccatcagcagccctgcagtctagaagtatttgacttaatttattactgtacagtctagtataagtacgtggtacggtacgttcggacaacggggtaccaagggttaacgaaataccgaaaacgtacgtggttaggcttacggacctacccgtatccgttacgttactttacc

SEQ ID NO: 442523 - DNA, 506 bp, Homo sapiens
  misc_feature: GZ8MTXP02GVVCD.2.7.A07.1.454.CMB.2.raw
  modified_base (196)..(196): a, c, t, g, unknown or other
  modified_base (327)..(327): a, c, t, g, unknown or other
  modified_base (345)..(345): a, c, t, g, unknown or other
  modified_base (354)..(354): a, c, t, g, unknown or other
  modified_base (459)..(459): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccagctcctcatctatgctgcatccacagggccatggtatcccagccaggttcgngcaggtgggctgggcagngttcattcncacatcagcagcctgcagtctgaagtatttgactaaatttatactgtcagtcagtaataaataactggtaggtacgttcggaccaaaggggacctaaagggtaanaaaactacgaaaacgtactagtaggactgacacatctcgtctactac

SEQ ID NO: 442524 - DNA, 527 bp, Homo sapiens
  misc_feature: GZ8MTXP02G4A7A.2.7.A07.1.454.CMB.2.raw
  modified_base (198)..(198): a, c, t, g, unknown or other
  modified_base (285)..(285): a, c, t, g, unknown or other
  modified_base (366)..(366): a, c, t, g, unknown or other
  modified_base (394)..(394): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtattagcagcaacttagcctggtaccagcagaaacctggccaggctcccaggctccncatctatgctgcatccacagggccactggtactcccagccaggttcagtggcaggtgggtctggggacaggagttcattcncaccatcagcagctgcagtctagaagtntttgactaatttatactgtacagtcaagttataatagtggtggtaacgttcggaccgtaaagggaccgaaaggtaagaaaacgttacaaaacgaactggtaggaactacgacactattcctagttaccttacg

SEQ ID NO: 442525 - DNA, 555 bp, Homo sapiens
  misc_feature: GZ8MTXP02HBH2X.2.7.A07.1.454.CMB.2.raw
  modified_base (368)..(368): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatcccaccagggcccacgtggtactccccagccaggttcagtggcaggtgggctggggacagagttcattcncacatcagcagcctgcagtctagaagtatttgacttaaattttacttacttgtactaggtactaagttaactaaagttaacgtgggtaggtacgttacggacccgtaaagggacccgtaaagggtaacgaaagttacaaaacgtacgtaggtaggaactaggacctaacattcgtacgttacttacc

SEQ ID NO: 442526 - DNA, 512 bp, Homo sapiens
  misc_feature: GZ8MTXP02IXADH.2.7.A07.1.454.CMB.2.raw
  modified_base (365)..(365): a, c, t, g, unknown or other
  modified_base (382)..(382): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatccacagggccactggtactcccagccaggttcagtgcaggtgggtctggggacaggtagttcattcncaccatcagcagctgcngtctagaatatttgacttaattttatacttgtcagtactagtataatacgtggtgtacgtcggacgtaagggacaaaggtacgaaatacgaaaacgtaacgtgagaacgtgacacctatcgtgtacttac

SEQ ID NO: 442527 - DNA, 517 bp, Homo sapiens
  misc_feature: GZ8MTXP02JZPAD.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccaccctctcctgcagggccagtcagagtattagcagcaacttagcctggtaccagcagaaacctggccaggctcccaggctcctcatctatgctgccatccaccagggccactggtatccccagccaggtcagtggcagtggggtctgggggacaggagttcattctcaccatcagcagcctgcagtctagaagtatttgacttaatttattactgtacagctatataatacgtggtggtacgttcgaccgtaagggaccaaagggtacgaaaatacgaaaacgaacgtgtaggctaggacaccgtatctcgtactttc

SEQ ID NO: 442528 - DNA, 536 bp, Homo sapiens
  misc_feature: GZ8MTXP02JQ80Q.2.7.A07.1.454.CMB.2.raw
  modified_base (367)..(367): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactccccagccaggttcagtggcagtgggtctggggacaggagttcatttccncacctatcagcagcctgcagtctagaagttatttgactaatttattacttgtctagctaagtaataactaagtggtacggtacggttacggacgtaaacggggacctaaagggtaagaaaacgtacgaaaacgaacgtgtaggctacggacctacatctacgttcttac

SEQ ID NO: 442529 - DNA, 507 bp, Homo sapiens
  misc_feature: GZ8MTXP02H8JPH.2.7.A07.1.454.CMB.2.raw
  modified_base (196)..(196): a, c, t, g, unknown or other
  modified_base (363)..(363): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacctggccaggctcccaggctcctcatctatgctgcatccaccagggccacgtggtactcccagccaggtcagtgcagtgggtctggggactagagtttcattcncacccatcagcagcctgcagtctagaagtatttgacttaatttattactgtcagtacagtaataataacgtggtaggtacgttcggaccgtaagggaccaaagggtagaaatacgaaacgactgagcgtgacacatctgtactc

SEQ ID NO: 442530 - DNA, 537 bp, Homo sapiens
  misc_feature: GZ8MTXP02GWE2R.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcactccaccgagggcccacgtggtaactccccagccagggttcagtggctaggtgggtctggggacaggtagttcattctcaccatcagcagcctgcagtctagaagtatttgactaatttattactgtacagtctaagttaataagtaacgtggtacggtacgttacggaccgtaaaggggaccaaagggtacgaaatacgaaaacgtactgtacggaactcgacactatctcgtactttacg

SEQ ID NO: 442531 - DNA, 552 bp, Homo sapiens
  misc_feature: GZ8MTXP02HU0OU.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatccaccagggccacgtggtactccccagcccaggttcagtggcaggtggggtctgggggacaggtagttccattcctcaccatcagcacgcctgcagtctagaagtatttgacttaattttattacttgtacagactagtaataataacgtggtaggtacgttacggaccgtaaaggggaaccgtaaagggtaacgaaaacgttacgaaaacgtaacgtagtaggaactacggacctaccattaccgtgttacttcg

SEQ ID NO: 442532 - DNA, 598 bp, Homo sapiens
  misc_feature: GZ8MTXP02IK5GG.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatccaccagggccacgtggtactcccagcctaggttcagtggcaggtgggtctgggggacaggtagttcattcacaccatcagcagcctgctagtctagaagtattttagacttaaattttattacttgtacagtactaagttaattaaattaacgtgggttacggtaccggtttacgggaacccgtaaacggggaaacccgtaaaagggtaaacgaaaacgttaccgaaaaacggtaaccgttaggtacgggtaaccttacggaacctaacccgtaatttccgttacgtttacctttaccg

SEQ ID NO: 442533 - DNA, 520 bp, Homo sapiens
  misc_feature: GZ8MTXP02GELVP.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcaggtgggtctggggacaggagttcattctcaccatcagcagcctgcagtctgaagtattttgactaatttattactgtcagtcaagtataataacgtggtaggtacgttcggaccgtaaaggggaccaaagggtaacgaaaactacgaaaacgaactggtaggctagactatacactctagttcc

SEQ ID NO: 442534 - DNA, 531 bp, Homo sapiens
  misc_feature: GZ8MTXP02I4DT7.2.7.A07.1.454.CMB.2.raw
  modified_base (315)..(315): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccagctcctcatctatgctgcatccacagggccatggtacncccagccaggttcagtggcagtgggctggggacaggagttcattcacaccatcagcagcctgcagtctgaatatttgacttaaatttacttacttgtacagtactaagttataaagtaacgttggtaggtaacggttcggaccgtaaaggggaaccgaaaggtaagaaaactacgaaaacgtaactgtacggctacgacacctatctgttacttac

SEQ ID NO: 442535 - DNA, 506 bp, Homo sapiens
  misc_feature: GZ8MTXP02IG2WG.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggctcctcatctatgctgcatccaccagggccactggtactccccagccaggttcagtggcagtgggtctgggggacaggagttcattctcaccatcagcagcctgcagtctagaagtatttgactaatttattactgtcagcagtataatacgtggtggacgttcggaccgtaaagggaccaaaggtagaaaatacaaacgaactgtaggctgacacatctagtcttc

SEQ ID NO: 442536 - DNA, 660 bp, Homo sapiens
  misc_feature: GZ8MTXP02HTL3T.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccgaggcctcctcatctatcgctgccactcccaccgagggccctacgtggtactccccgagccctaggttccaggtcggactagggttcggggtctgggggactaggtacgtttcctagttcctacaccctatcgacgcaacgtccctgacctaggttctaggtaaagttagttttacgactttaaattttattaacgttgtactagtactaagttaataaagttaacgtgggttacggtaccggttacgggaaccggtaaaacggggtaaccgtaaaaggggtaaacgtaaaacgttaacccgaaaaaccggttaacgtagggttacggtaaccgttacggaaccctaaaccggtaactttcccgttacgtttaccctttaccg

SEQ ID NO: 442537 - DNA, 624 bp, Homo sapiens
  misc_feature: GZ8MTXP02HJK3X.2.7.A07.1.454.CMB.2.raw
  modified_base (611)..(611): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggaccaggcctcccgaggcctcctcatctatgctgccactcccaccgaggggcccaacgttcggtaactcccccgaaggtccctaacgggtttccagggtcgggctaacggggttcggggttcctgggggaacctagggtacgtttccaagtttccacaacccgatccaggaccacggcctgactagtctagtaaagttattttgacttaaatttttactacttagtacagtactaagttaactaattaacgtgggttacggtaacgttcggaaccgtaaaggggtacctaaaggggttaacaaaactacgaaaacgtacgtaggtacgaaccgtagactaacctntcgtacgttactc

SEQ ID NO: 442538 - DNA, 523 bp, Homo sapiens
  misc_feature: GZ8MTXP02F4UT6.2.7.A07.1.454.CMB.2.raw
  modified_base (363)..(363): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtgcagtgggtctggggacaggagttcattcncaccatcagcagcctgcagtctagaagtatttgacttaaatttattactgtacagcaagtataatacgtggtaggtacgttcggaccgtaaagggaccaaagggtagaaaactacgaaaacgtacgtaggtacggcgtagacaaccatctacgttcttac

SEQ ID NO: 442539 - DNA, 518 bp, Homo sapiens
  misc_feature: GZ8MTXP02IOVND.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggctcctcatctatgctgcatccaccagggccactggtactccccagccaggttcagtgcaggtgggtctggggacagtagttcattctcaccatcagcagctgcagtctgaagatttgactaaattttatacttgtcagcagtataataacgtggtggtacgttcggaccgtaaggggaccaaaggtagaaaattacgaaaacgtaaactgtaggaactcgacaccatcctgtactttac

SEQ ID NO: 442540 - DNA, 524 bp, Homo sapiens
  misc_feature: GZ8MTXP02I7W1K.2.7.A07.1.454.CMB.2.raw
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccaccctctcctgcagggccagtcagagtattagcagcaacttagcctggtaccagcagaaacctggccaggctcccaggcctcctcatctatgctgcatccaccagggcccactggtactccccagccaggttcagtggcagtgggtctggggacaggagttcattcncaccatcagcagccctgcagtctagaagatttgactaattttattactgtcagtcagtataataacgtggtgacgttcggaccgtaaaggggaccctaaagggtacgaaaattacgaaaacgtacgtgtaggctaggacaccatcgtacgtactttac

SEQ ID NO: 442541 - DNA, 577 bp, Homo sapiens
  misc_feature: GZ8MTXP02JZXX3.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccagctcctcatctatgctgcatccaccgagggccacgtggtactccccagccaggttcagtcggctaggtgggtctggggacaggtacgttcattctcacccatccagcagcctgccagtctagtaagtattttgactaatttattaactgtacagtactagttaataaataacgttgggtaggtacgtttacggaccgtaaaacggggaacctaaagggtaacgaaaacgttacaaaaacggtaaaccgttaggtaggtaaccgttaggtaaccaccgtaattccgttacggttcctttaccg

SEQ ID NO: 442542 - DNA, 521 bp, Homo sapiens
  misc_feature: GZ8MTXP02JZ773.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctccaggctcctcatctatgctgcatccacagggccactggtactccccagccaggttccagtggcaggtggggtctgggggacaggtacgttcattctcaccatcagcagcctgcagtctagaagtatttgacttaatttatactgtactagctaagtataatacgtggtagtacgtcgacgaacgggacaaggtaacgaaactacgaaacgaacgtggtacggctcgacacctagtctacgtctttacg

SEQ ID NO: 442543 - DNA, 569 bp, Homo sapiens
  misc_feature: GZ8MTXP02H1FHP.2.7.A07.1.454.CMB.2.raw
  modified_base (284)..(284): a, c, t, g, unknown or other
  modified_base (411)..(411): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctccaggctcctnatctatgctgcatccaccgagggcctacgtcggtactccccagcctaggttcagtggacaggtggggtctgggggacaggtacgttcattcacaccctatcagcagccctgctagtctagaacgttntttgacttaattttattactgtacagtacgtaataataagttacgtggtacggtacgtacgaacggtaacgggaaacgtaaacgggtaaataaacgtaaaacgaaacgtaacgtaggacgtaacgtcgaacctacgtacttacgtcgtttaccttacc

SEQ ID NO: 442544 - DNA, 523 bp, Homo sapiens
  misc_feature: GZ8MTXP02JZFSX.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatccaccagggcccactggtactccccagccaggttcagtggcaggtgggtctgggggacaggtagttcattctcaccatcagcagcctgcagtctagaagtatttgacttaaatttattactgtcagctagtattaatacgtggtggtacgttcggaccgtaacggggaccaaaggtaacgaaatacgaaaacgaacgtgtaggcgtcgacacctatctcgtacttac

SEQ ID NO: 442545 - DNA, 540 bp, Homo sapiens
  misc_feature: GZ8MTXP02JE31N.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagcctggtaccagcagaacctggccagctccaggctctcatctatgctgcactccaccacgggccacgtggtactccccagcctaggttcaggtgactaggtcggggtctgggggacaggtagtttcatttcacacctatcagcagcctgcagtctagtaagtatttgacttaatttattactgtacagtactagtaataataacgtggtagtacgttacggaccgaaagggaccaaaggtaacgaaactaacgaaacgtaccgtagtcgtaacgtagacctacatctacgttccttacg

SEQ ID NO: 442546 - DNA, 542 bp, Homo sapiens
  misc_feature: GZ8MTXP02HH39B.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccaggctcctcatctatgctgcatccaccagggccatggtactcccagccaggttcagtggcagtggggtctgggggacaggagttcatttccacacccatcagcagccctgcagtctagaagtatttgactaattttatacttgtacagtactagtattaataacgtggtaggtacgttcggaccgtaaaggggaccaagggtaacgaaaacttacgaaaacgtacgtaggtaggaacctaggacctaccgatccgtagttactttacg

SEQ ID NO: 442547 - DNA, 603 bp, Homo sapiens
  misc_feature: GZ8MTXP02J3HYJ.2.7.A07.1.454.CMB.2.raw
  modified_base (197)..(197): a, c, t, g, unknown or other
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaaacctggccaggctccaggcctcctnatctatgctgcatccaccgagggccacgtggtactccccgagcctagggttccaggtcggactaggtcggggtactggggacaggtacgttcattctacacccatccgagcacgtccctgcgtagtctagtaaacgtttatttacgactttaatttacttacgtgtacgagtacgtaagttaacgttaaacgtacggttcggggttacggtaaccggttaccgggaacgtaaaacgggaaccgtaaaggtaaacgaaactaaccgaaacgtacgttcggtacgcgtacgacctaccgtacttccgttacttccttacg

SEQ ID NO: 442548 - DNA, 550 bp, Homo sapiens
  misc_feature: GZ8MTXP02H77BX.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaangccacctctcctgcagggccagtcagagtatagcagcaacttagcctggtaccagcagaaaccctggccggctcccaggctcctcatctatgctgcatcccaccagggcccactggtactccccagcctaggttccagtggcaggtgggctgggcagtagttcattctcacatcagcagcctgctagtctagaagtattttgacttaaattttatttactgttcagtctaagttataaataacgttgggtacggtacgttcgggaccgtaaaggggtaccaaaggttaagaaaactacgaaaaccgacgtaggttcggacttaaggacaacctatacgtcgttctttacacc

SEQ ID NO: 442549 - DNA, 543 bp, Homo sapiens
  misc_feature: GZ8MTXP02F5NH8.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaaacctggccaggcctcccgaggcctcctcatctatgctgcatcccaccgagggcccacgtggtactcccagccagggttcagtggctaggtcggggtctgggggacaggtagttccattcacaccatcagcagcctgccagttctagtaagtattttgacttaaattttagttactgttacagtacaagttaataagtaacgtggtacggacgttcggaacaagggactaaaggtacaaagtacaaaacgacgtgtaggctcgacactagtctacgtcttac

SEQ ID NO: 442550 - DNA, 599 bp, Homo sapiens
  misc_feature: GZ8MTXP02H7J59.2.7.A07.1.454.CMB.2.raw
  modified_base (198)..(198): a, c, t, g, unknown or other
  modified_base (458)..(458): a, c, t, g, unknown or other
  modified_base (553)..(553): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanacgccaccctctcctgcgagggccagtcagagtattagcagcaacttagcctggtaccagcaagaaacctggccaggcctcccgaggcctcctcatctatgctgcactcccaccgagggccctagtggtaacctccccgagccgtaggttccaggtcggcgtagggtcggggtcgtgggggaacctaggtacgtttactactttcctaccaccctacgtcacggaccacgtccctggactacggttctaggtaaagtttnttttagactttaaatttttacttaacgttgtacaggtacttaagtaactaaagttacgtgggtacggtacgtcggacgtaaagggacaaggtaanaaatacgaaacgtacgtgacgaactcgaccactatcgtacttctac

SEQ ID NO: 442551 - DNA, 618 bp, Homo sapiens
  misc_feature: GZ8MTXP02HJLL2.2.7.A07.1.454.CMB.2.raw
  modified_base (435)..(435): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagcccaccctctcctgcagggccagtcagagtattagcagcaacttagcctggtaccagcaagaaacctggccaggcctcccgaggcctcctcatctatgctgcactcccaccgagggcccagtggtactccccagccacgggttcaggtcggcgtagggtcggggtctgggggaactagggtacgtttcatttccgacacctatccagccacggcccttggactagtctaggaagttntttgaacttaatttttattacgttgtacagtactaagttataaagtaacgttgggtacggtaccgttacgggaacccgtaaaagggggtaacctaaaggggtaaactaaaacgttaaccgaaaacgtaacgttggttacggaaccgtacgacctaaccgtattccgttacgttaccctttacg

SEQ ID NO: 442552 - DNA, 618 bp, Homo sapiens
  misc_feature: GZ8MTXP02IIS11.2.7.A07.1.454.CMB.2.raw
  modified_base (195)..(195): a, c, t, g, unknown or other
  modified_base (204)..(204): a, c, t, g, unknown or other
  modified_base (436)..(436): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaangccacctcnctgcagggccagtcagagtatagcagcaacttagcctggtaccagcaagaacctggccaggcctcccaggcctcctcatctatgctgcatcccaccgagggccctagtcggtaactccccgagtcccgtaggtttcaggtcgggacgtagggttcggggtctgggggacctaggtacgttacctagtttcaccacctatcgagcacggcctgacagttactagtaaaagttntttacgtaactttaaattttacttacgttagtacgagtactaagttaattaaagttacggttagggtacggtaccggttacggaaccggtaaacgggaacgtaaaaggtaaacgtaaaacgtaaacgaaacgtaacgttggtacggtaacgtacgactactacgttccgttacgttacttcg

SEQ ID NO: 442553 - DNA, 605 bp, Homo sapiens
  misc_feature: GZ8MTXP02HRLO5.2.7.A07.1.454.CMB.2.raw
  modified_base (384)..(384): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctcctcctgcgacgggccagtcagagtattagcagcaacttagcctggtaccagcaagaaacctggaccaggcctcccgaggcctcctcatctatcgctgcatcccgaccgagggcccacgtggtactccccgagcccgtagggttcaggtcggcgtaggtcggggttctggggactaggngtttccatttccacaccatcagcacgcctgctagtctagaagttactttgactttaaatttacttacgttgtacaggtctaagttaataacttaacgtggggtacgtacggttacggaaccgtaaagggggaaacctaaagggaaactaaaacgttaccgaaaacgtacgttaggacggtaacctacggacctaccctatccgttacgtttctttaacccg

SEQ ID NO: 442554 - DNA, 556 bp, Homo sapiens
  misc_feature: GZ8MTXP02H8E47.2.7.A07.1.454.CMB.2.raw
  modified_base (197)..(197): a, c, t, g, unknown or other
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggaccagcagaaacctggccaggctcccaggctcctcatctatgctgcatcccaccagggtcccatggactcccagccaggtcagtgctagtggggtctggggactagagtttcattcncacccatcagcacgcctcgctagtcgtagtaagtagtttagtacttaatttaatttacttatactagtatagtaataaataacgtaggtaggtacggttacggtacggtaacggaacgtaacggtaaacgtaaacgtaaacgaaacgtaacgtacgtacggtaacgtacgacacactactacgttactac

SEQ ID NO: 442555 - DNA, 552 bp, Homo sapiens
  misc_feature: GZ8MTXP02HCUZD.2.7.A07.1.454.CMB.2.raw
  modified_base (196)..(196): a, c, t, g, unknown or other
  modified_base (362)..(362): a, c, t, g, unknown or other
  modified_base (390)..(390): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttgcctggtaccagcagaacctggccaggctcccaggctcctcatctatgctgcatccacagggccatggtactcccagccaggttcagtggcaggtgggtctggggacaggtagttcatttcncaccatcagcagcctgcagtctagaatntttgacttaatttatacttgtcagactagtaataataacgtggtacggtacgttcggacccgtaaaaggggaacctaaaggggtaacgaaaacgttacgaaaaccggtaacgttaggtacggcgtacggaccctaacctacttccgttcgttacctttaccg

SEQ ID NO: 442556 - DNA, 569 bp, Homo sapiens
  misc_feature: GZ8MTXP02JU6QX.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggcccactggtactccccagccaggttcagtggcaggtgggtctggggacaggtagtttcagtttcctacacccatcaagcagccctgcagtctagaagtattttgacttaattttattactgttacagtactaagttaataaagtaacgtgggtacggtacgtttcgggaccgaaaacggggtacccaaagggtaacgtaaaataccgaaaacgtaaccgtggtacggtcgtacggaccaaccctatccttacgtctttaacc

SEQ ID NO: 442557 - DNA, 566 bp, Homo sapiens
  misc_feature: GZ8MTXP02JJDNG.2.7.A07.1.454.CMB.2.raw
  modified_base (370)..(370): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcaagaaacctggccaggcctcccaggcctcctcatctatgctgcatccacgagggccactggtactcccagccaggttcagtgctagtgggtctggggacaggtacgttcagttcncacatcagcagcctgctagtctagaagtactttgactaattttatactgtacagtacaagtataaagtacgtgggtcggtaaccgttcgggaaccctaaaagggggtaccaaaggggttaaacgaaaacgttaaccgaaaacgtaacgttggtaacggcttacggacctacctagttccctaggttacctttaccg

SEQ ID NO: 442558 - DNA, 631 bp, Homo sapiens
  misc_feature: GZ8MTXP02HS2RZ.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaangccaccctctcctgcagggccacgtcagagtattagcagacaacttaacgtcctcggttaccgacgcagaaacctacggccgaacggctcccacggctcctccatctactgctcgtcactccacccaagggccgacctggtacgtccccacgccacggttcgacgtgggccgagttggggtctcggggtacgacgtaggtttcctattacttccacccacttcacggcaacgccttcgcacgtcgtgaagtatttgtactaattttaatttacttagtcagactaagtataaattaacgtggttaggtaccggtacggtaccgaaacggggtaaccgtaaaggtaaagtaaaacgttaaacaaaacggtaaaaccgttcggttaggaaccgttcggaccgttaaccgaactttaccttaggtttcctttaaccc

SEQ ID NO: 442559 - DNA, 533 bp, Homo sapiens
  misc_feature: GZ8MTXP02JY72S.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccgaggctcctcatctatgctgcatcccaccgagggccacgtggtactccccgagccaggttcagtggcaggtggggtctgggggacaggtagtttcattctacaccatcagcagcctgcagtctagaagtatttgacttaatttattactgtcagtacagtataatacgtggtagtacgttcgaccaagggaccaaaggtacgaaatacgaaaacgaacgtggtacggaactacggacaccgtatctacgtacttaccg

SEQ ID NO: 442560 - DNA, 607 bp, Homo sapiens
  misc_feature: GZ8MTXP02G4CRA.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggcctcccgaggcctcctcatctatgctgcatccaccgacgggccacgtcggtactccccgagccgtaaggttccaggtggcaggtcgggtctggggacaggtacgttcagtttccacacctactcacgcacgccgtcgactagtctagtaagttagtttagtacttaatttactttaacgttgttacgtagtacgtaagttaattaaagttaacgttaggttacggtacggttacggaccggtaaacgggaaccggaaagggtaaacgaaacgtaacgaaaacgtaacgtaggtaggaacgtagaccccccccgtatactacttacgttctttacg

SEQ ID NO: 442561 - DNA, 548 bp, Homo sapiens
  misc_feature: GZ8MTXP02G882E.2.7.A07.1.454.CMB.2.raw
  modified_base (364)..(364): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggctactggtactcccagccaggttcagtggcaggtgggtctggggacaggagttcattcncaccatcagcagcctgcagtctagaagtatttgactaaatttagttactgtacagtctaagtaataagttaacgtgggtaggtaaccgtttcgggacccgtaaaagggggaccctaaagggtaacgtaaaacttacgaaaacgtaacgtggtaaggctacggacaccgatcgtacgtctttacc

SEQ ID NO: 442562 - DNA, 536 bp, Homo sapiens
  misc_feature: GZ8MTXP02GJRLC.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggccactggatcccagccagtcagtgcagtggtctggggacaggagttcattctcaccatcagcagcctgcagtcagaatatttgactaatttattactgtacagtctaagtaataataacgttggtacggtacgttccgggacctaaacggggacctaaaggggtaacgaaaacgtacgaaaacgaacttggtaggaacgtacgaccaacctagtcttacggttcctttacg

SEQ ID NO: 442563 - DNA, 568 bp, Homo sapiens
  misc_feature: GZ8MTXP02GYILZ.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcaagaaacctggccaggcctcccaggcctcctcatctatgctgcatcccaccagggcccacgtggtactccccgagtcctaggttccaggtcggctaggtcggggtctgggggactagggtacgtttccaagtttccacaaccctataccaaggccaaggtccctgacagtctagaagttatttgactaatttatactgtcagactaagtaataataacgtggtaggacggttcgaccgtaacgggaccaaagggtaacaaacgtaacgaaaacgactaggtacggctaggaccactagtcttacgtaccttac

SEQ ID NO: 442564 - DNA, 521 bp, Homo sapiens
  misc_feature: GZ8MTXP02HTJF5.2.7.A07.1.454.CMB.2.raw
  modified_base (362)..(362): a, c, t, g, unknown or other
  modified_base (406)..(406): a, c, t, g, unknown or other
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggctcctcatctatgctgcatccacagggccatggatccccagccaggttcagtggcaggtgggtctggggacaggagttcattcncaccatcagcagcctgcagttctgaagtattttgctaaattttnttactgtcagcagtataataacgtggtagtacgttcggacctaaggggacctaaagggtacgaaaagttacgaaaacgaacgtggtaggctaggacctaccatcctgttctttac

SEQ ID NO: 442565 - DNA, 539 bp, Homo sapiens
  misc_feature: GZ8MTXP02HIOP6.2.7.A07.1.454.CMB.2.raw
  modified_base (284)..(284): a, c, t, g, unknown or other
  modified_base (315)..(315): a, c, t, g, unknown or other
  modified_base (391)..(391): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctccncatctatgctgcatccacagggccatgtacncccagcctaggtcagtcgcaggtggctggggacagacgttcattcacaccatcagcagcctgcagtctagaacgtntttagacttaaattttatacttgactagactagttaataagtaacgtgggtacggtacgttcggaaccgtaagggaacctaaagggtacaaaagttacaaaacgacgttggtacgaactaggaccaccgattcgtacgtttacttacg

SEQ ID NO: 442566 - DNA, 591 bp, Homo sapiens
  misc_feature: GZ8MTXP02JT6FY.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgccatcccaccgacgggcccacgtggtactccccagccaggttcagtcggcaggtgggtctgggggacaggtacgttcattcctacaccatcagcagccctgcagtctagaagtatttgacttaatttatactgtcagtctaagtataaagtacgtggtacggtacgttacgggaccgaaacggggtaacccgtaaagggtaacgaaaacgttaaccgaaaaaccggtaacgtagggtacgggtaaccgttacggaaccctaacccgtaacttcccgtttacggttacccttttaccg

SEQ ID NO: 442567 - DNA, 522 bp, Homo sapiens
  misc_feature: GZ8MTXP02FTQ9W.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngccaccctctcctgcagggccagtcagagtattagcagcaacttagcctggtaccagcaagaaacctggccaggctcccaggctcctcatctatgctgcatccaccagggccactggtactcccagccaggttcagtgcaggtgggtctggggacaggtagttcattctcaccatcagcagcctgcagtctagagtatttgacttaatttatactgtcagctaagtataatacgtgggagtacgttcggaccgaaagggacaaaggtaacaaatacgaaaacgtaacgtggtaggaactacgacaacctatctcgtactttacc

SEQ ID NO: 442568 - DNA, 604 bp, Homo sapiens
  misc_feature: GZ8MTXP02I67G2.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggctcccaggctcctcatctatgctgcatccaccgagggcccacgtcggtactccccagcctaggttcaggtggctaggtgggtctgggggacaggtagttcattcctacacctatcagcacgccctgactagtctagaagtatttgacttaaattttattacttgtactagactaagtaattaaataacgttggtacggtacgtttaccgggaccgtaaaacggggtaaccgtaaaaggggtaaacgaaaacgttaaccgaaaaacggtaaccgttaggttaacgggaaccgttacggaaccctaaccgtaattccgttacgtttacctttaccg

SEQ ID NO: 442569 - DNA, 535 bp, Homo sapiens
  misc_feature: GZ8MTXP02G0TEN.2.7.A07.1.454.CMB.2.raw
  modified_base (408)..(408): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttagcctggtaccagcagaaacctggccaggcctcccgaggcctcctcatctatgctgcactcccaccgacgggccacgtcggtactcccagccaggttcagtggcaggtgggtctgggggacaggtagttcattcacacatcagcacgcctgactagtctagtaagtntttgacttaagtttatactgtacagtactaagtaataagtacgtgggtacggtacgtcggaccgaaacgggacgaaaggtaacaaagtacgaaacgactggtaggctcgacactatcttcgtacttc

SEQ ID NO: 442570 - DNA, 579 bp, Homo sapiens
  misc_feature: GZ8MTXP02GGPSP.2.7.A07.1.454.CMB.2.raw
  modified_base (567)..(567): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagacaacttagcctggtaccagcagaaacctggccaggcctcccgaggcctcctcatctatgctgacactcccaccgagggcccacgtggtactccccgagcctagggttccaggtcggcgtaggtcggggtcgtgggggacaggtacgttcagtttccaccacctattccgaacgcgacgcctgactaggttctaggtaagttattttcgaactttaaattttacttacgtgttacagtactaagttataatacgtggtacgtacgtacgacgtaaagggactaaaggtaacgaaatacgaaacgtaacgtggtacgcgtacgacaccgtntcgtactactac

SEQ ID NO: 442571 - DNA, 535 bp, Homo sapiens
  misc_feature: GZ8MTXP02GK34B.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatcccacagggccactggtactcccagccaggttcagtggctaggtgggtctggggacaggtacgtttcagttctacaccctatccgagcagcctgcagtctagaatattttgacttaaatttattactgtcagtactaagttataagttaacgtgggtacggtacgttcgggacaaacggggacctaaagggtacgaaaatcgaaaacgactgtaggctagacaccatctcgttcttac

SEQ ID NO: 442572 - DNA, 599 bp, Homo sapiens
  misc_feature: GZ8MTXP02H4BMT.2.7.A07.1.454.CMB.2.raw
  modified_base (198)..(198): a, c, t, g, unknown or other
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctcgagggggaaancgccaccctctcctgcagggccagtcagagtattagcagctaacttagccgtggtaccagcaagaaacctggccaggcctccaggcctcctcatctatgctgacatcccacgagggccagtggtaactccccagcctaggttcaggtcggctaggtggggtctgggggactaggtcgtttcatttcacaccatcagcagcctgcagtctagaaagttntttgacttaattttattacgtgtacagtactaagttataaagttaacgtgggttacgggtaccgttcgggaaccgtaaaacggggaaccgtaaaagggtaaagtaaaacgtaaccgtaaaaacgtaacgttaggtacgggaactacggaacctacccgtaattccgttacgtttaccttaccg

SEQ ID NO: 442573 - DNA, 526 bp, Homo sapiens
  misc_feature: GZ8MTXP02ISWO4.2.7.A07.1.454.CMB.2.raw
  modified_base (352)..(352): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatccaccagggccactggtactccccagccaggttcagtgcaggtgggtctggggacngtagttcattctcaccatcagcagcctgctagtctagaagtatttgactaaattttatacttgtacagtctagtataatacgtggtggtacgttcggaccgtaaagggaccaaagggtacgaaaactacgaaaacgtaactggtaggaactgacacctatcgttcgtctttacg

SEQ ID NO: 442574 - DNA, 535 bp, Homo sapiens
  misc_feature: GZ8MTXP02JXJ1U.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanacgccaccctctcctgcagggccagtcagagtattagcagcaacttagcctggtaccagcagaaacctggccaggctcccagcctcctcatctatgctgcatcccacgagggcccatggtactcccagccaggttcagtgcaggtgggctggggacagagtttcattcacaccatcagcagcctgctagtctagaagtattttgacttaaatttatactgtacagactaagttaataagttaacgtggtaggtacgttcggaaccgtaacggggacaaaggtaacaaacgtacaaaacgtaactggtacggaactgacctacgactcctagtactttac

SEQ ID NO: 442575 - DNA, 545 bp, Homo sapiens
  misc_feature: GZ8MTXP02HN5NA.2.7.A07.1.454.CMB.2.raw
  modified_base (370)..(370): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatccaccgagggccactggtactccccagccaggttccagtggcagtgggtctggggacagagtttccatttcncaccatcagcagcctgcagtctagaagtatttgactaattttatacttgtacagtactaagtataaataacgtggtacggtaacgttcgaccgtaaagggaccgtaaaggtacggaaaactacgaaaacgtaacgtaggtacgaacgtacgaccaacctatccgtgtttcttacg

SEQ ID NO: 442576 - DNA, 629 bp, Homo sapiens
  misc_feature: GZ8MTXP02GTNCD.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatcccaccagggccacgtggtactcccagccaggttcagtggcaggtgggtctggggacaggtcgttctattctacacatcagcacgtcctgactacgtctagtaagttattttagtactttaaatttagttacttagtactaaggtactaaagttaagttaaaggttaacggttacggggttacggtaaccggtttaacggggaaccccgtaaaagggggtaacccgtaaaaagggttaaacggaaaaacgttaaccgtaaaaacggtaaaccgttggttaacggaaccgtacggacctaacccgtagttcctttacggttacctttacccg

SEQ ID NO: 442577 - DNA, 547 bp, Homo sapiens
  misc_feature: GZ8MTXP02J0K5U.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccaggcctcctcatctatgctgcatcccaccgagggcccacgtggtactcccagcctaggttccaggtcggctaggtcggggtcgtgggggacaggtacgttcatttctacaccatcagcacgcctgctagtctagaagtatttgactaattttatactgtcagtctagtataatacgtggtaggtacgttcgggaccgtaaaggggaccaaagggtaacgaaaataccgaaaacgtaactggtaggctcgacctaccatctcgtacttacg

SEQ ID NO: 442578 - DNA, 568 bp, Homo sapiens
  misc_feature: GZ8MTXP02IZR17.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtattagcagcaacttagcctggtaccagcaagaaacctggccaggcctcccaggcctcctcatctatgctgccactcccacccgacggggcccacgttcggtactccccgagcccagggtttccaggtggcgtaggttcggggtctgggggaccaggtacgttcattccgtcaccatcagcagcctgcagtctagtaagttatttgacttaaatttattactgtactagtactagtaataatacgtggtacggtacgttcggacgtaaacgggacgaaaggtaacgaaactacgaaaacgtaacgtggtacggtctacgactactattctacgtactttacc

SEQ ID NO: 442579 - DNA, 597 bp, Homo sapiens
  misc_feature: GZ8MTXP02H9PDN.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtatagcagcaacttagcctggtaccagcagaacctggccaggctcccaggctcctcatctatgctgcatccaccagggccacgtggtactcccagcctaggttcagtggcaggtggggtctgggggacaggtacgtttcagtttcacaccctatcgagcacgcctgctagttctagtaagttatttgacttaaattttattacttgtacagtactaagtaattaaagtaacgtaggggttaggtaaccgtttcgggacccgtaaaaggggtaacccgtaaaagggtaaacgtaaaaactaccgtaaaaacgtaacgttaggtacggtaacgtacggacctacccgtaattcccgttagttcctttaccg

SEQ ID NO: 442580 - DNA, 539 bp, Homo sapiens
  misc_feature: GZ8MTXP02GNWT4.2.7.A07.1.454.CMB.2.raw
  modified_base (307)..(307): a, c, t, g, unknown or other
  modified_base (413)..(413): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggcctcccgaggcctcctcatctatgctgcatcccaccgngggccacgtggtactcccagccaggttccaggtcggcagggtcgggtctgggggacaggtacgttcacttctacaccctatcagcacggcctgcagtctagaagtntttgacttaatttattctgtacagtctaagtataatacgtggtagtacgttcgacgtaaacgggactaaagggtaacaaatacgaaaacgtaacgtggtacgcgtgactaccagtctacgtcttac

SEQ ID NO: 442581 - DNA, 514 bp, Homo sapiens
  misc_feature: GZ8MTXP02GF0QR.2.7.A07.1.454.CMB.2.raw
  modified_base (196)..(196): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccatggtactcccagccaggttcagtggcagtgggtctggggacaggtagttcatttcncaccatcagcagcctgcagtctgaagtattttgacttaaatttattactgtcagctagtaataataacgtggtgtacgttcggacctaaagggaccaaaggtacgaaatacgaaaacgtactgtaggctgacaccgatctcgtacttac

SEQ ID NO: 442582 - DNA, 575 bp, Homo sapiens
  misc_feature: GZ8MTXP02JOLTQ.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccaggctcctcatctatgctgcactccaccgacgggccacgtggtactcccagccaggttcagtggctaggtgggtctggggacaggtagttcatttcacacctatcagcagcctgcagtctagaatatttgactaatttatactgtactagtactaagttaataaagttaacgtgggtaggtacggttacggacccgtaaaaggggaaccctaaaggggtaaacgtaaaacgtaaccgaaaacgtaaaccggttggtacggaactacggacctaaccgtattccgttacgttcctttaaccg

SEQ ID NO: 442583 - DNA, 517 bp, Homo sapiens
  misc_feature: GZ8MTXP02FOXUM.2.7.A07.1.454.CMB.2.raw
  modified_base (487)..(487): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggcccacgtggtactcccagccaggttccagtggcagtgggtctggggacagagttcattctcaccatcagcagcctgcagtctagaagtattttgactaatttattactgtcagacagttataattactggtggacgttggaccgaaagggaccaaagggtacgaaaatcaaaacgtaacngtaggctagacacctatcttacgtctttac

SEQ ID NO: 442584 - DNA, 524 bp, Homo sapiens
  misc_feature: GZ8MTXP02JMVBA.2.7.A07.1.454.CMB.2.raw
  modified_base (472)..(472): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctctcatctatgctgcatcccaccaggggccactggtatccccagccaggttcagtggcagtgggctggggacagagttcattctcaccatcagcagcctgcagtctagaagtattttgctaaatttattactgtacagacagtaataataacgtggtggacgtttacggaccgtaaaggggaccaaagggtanaaaactcgaaaacgaactggtaggctaggacctacgactcgtacgtctttac

SEQ ID NO: 442585 - DNA, 585 bp, Homo sapiens
  misc_feature: GZ8MTXP02I2C5M.2.7.A07.1.454.CMB.2.raw
  modified_base (383)..(383): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcagggccagtcagagtattagcagcaacttagcctggtaccagcaagaaacctggccaggctcccaggcctcctcatctatgctgcactccaccgagggcccagtcggtactccccagcctaggttccaggtggacaggttcggggtctgggggacaggtagttcatttcncaccatcagcagcctagcagtctagaagttatttgacttaaatttattacttgtacaggtactaagttacttaaagtaacgttggggtacgtaaccggttacggacccgtaaaaggggaccgtaaagggttaaacgaaaacgtacgaaaaccgtaacgtggtaacgggctacggacctaaccgattcttacgttctttaacg

SEQ ID NO: 442586 - DNA, 562 bp, Homo sapiens
  misc_feature: GZ8MTXP02HCRME.2.7.A07.1.454.CMB.2.raw
  modified_base (196)..(196): a, c, t, g, unknown or other
  modified_base (377)..(377): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccacgagggccatggtactcccagccaggttcagtgcagtgggctggggacagagttcatttcacatcagcacgcgtcgngacgtcgtacgtagtagtttcgttactaatttaatttactcgttacgacgtacgtaatagttaaataacgttaggtacggtacgttacggtacgaacggtaacggaacggtaagtaaacgtaaacgtaaacgtaaaccgtacgtaggtacgtaacgcgaaccgtactacgttacgtacttctacg

SEQ ID NO: 442587 - DNA, 525 bp, Homo sapiens
  misc_feature: GZ8MTXP02F8ZY5.2.7.A07.1.454.CMB.2.raw
  modified_base (356)..(356): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatcccaccagggccacgtggtactcccagccaggttcagtggctaggtgggtctgggggacnggtagttcattctacaccatcagcagcctgctagtctagtaagtattttgacttaatttattacttgtcagtacagtataatacgtggtagacgttcggaccaagggaccgaaaggtacgaaatacgaaaacgtacgtagtaggaactcgacacctatctacgtcttac

SEQ ID NO: 442588 - DNA, 546 bp, Homo sapiens
  misc_feature: GZ8MTXP02GQLCS.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtattagcagcaacttagcctggtaccagcagaaacctggccaggctcccaggcctcctcatctatgctgcatccacagggccacgtggtactcccagccaggttcagtgcagtgggtctggggacaggagttcattcacaccatcagcacgcctagcagtctagaagtatttgacttaatttattactagtactagtacaagttaataaataacgttgggtacggtacgtttacgggacgtaaacggggaacctaaagggtaaacgaaaatacgaaaacgtaaacgtggtaggaactgactaccatcgtacgtcttac

SEQ ID NO: 442589 - DNA, 531 bp, Homo sapiens
  misc_feature: GZ8MTXP02JCHP9.2.7.A07.1.454.CMB.2.raw
  modified_base (368)..(368): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactccccagccaggttcagtggcaggtcgggtctggggacaggtgttcatttcncaccatcagcagcctgcagtctagaagtatttgacttaaatttattactgtacagtctaagtataatacgtggtaggtacgttcggaccgaaagggaccaaagggtacgaaaatacgtaaaacgaacgtaggtacggctacggacacctatctacgtactttc

SEQ ID NO: 442590 - DNA, 524 bp, Homo sapiens
  misc_feature: GZ8MTXP02I5I4L.2.7.A07.1.454.CMB.2.raw
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccaccctctcctgcagggccagtcagagtattagcagcaacttagcctggtaccagcagaaacctggccaggctcccaggctcctcatctatgctgcatcccaccagggccacgtggtactccccgagcctaggttcagtggcaggtggggtctgggggacaggagttcattctcacatcagcagccctgcagtctgaaagtntttgactaatttattactgtcagtcaagtataatacgtggtgtacgttcggactaaagggacctaaggtacgaaaatacgaaaacgtacgtgtacggctaggaccacctatctcgttacttacg

SEQ ID NO: 442591 - DNA, 576 bp, Homo sapiens
  misc_feature: GZ8MTXP02HWWV4.2.7.A07.1.454.CMB.2.raw
  modified_base (198)..(198): a, c, t, g, unknown or other
  modified_base (304)..(304): a, c, t, g, unknown or other
  modified_base (354)..(354): a, c, t, g, unknown or other
  modified_base (363)..(363): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtatagcagcaacttagcctggtaccagcagaaacctggccaggctcccaggcctcctcatctatgctgcatccacngggccatggtactccagccaggttcagtggcaggtgggctggggactagngttcattcncacatcagcagccctgcagtctagaacgtattttagacttaaattttattacgtgtacagctaagtataaattacgtgggtacgtacgttcggacccgtaaaaggggaccctaaaggggttaaacaaaacgtaccgtaaaaaccggtaacgttggggtacggtaaccgttacggaaccacccggtaagtttacccttggtttaacctttcccg

SEQ ID NO: 442592 - DNA, 510 bp, Homo sapiens
  misc_feature: GZ8MTXP02IOIR2.2.7.A07.1.454.CMB.2.raw
  modified_base (369)..(369): a, c, t, g, unknown or other
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttgcctggtaccagcagaacctggccaggctcccaggctcctcatctatgctgcatcccaccagggcccactggtactccccagccaggttcagtggcaggtgggtctggggacaggtagttcagtttcncaccatcagcagcctgcagtctgaagtatttgactaattttatacttgtacagacagtataatactggtgtacgtcggacaagggactaaaggtacgaaaatacaaacgaactgtaggctacgacaccatactcgtacttc

SEQ ID NO: 442593 - DNA, 559 bp, Homo sapiens
  misc_feature: GZ8MTXP02HKKWS.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggcccactggtactccccagccaggttcagtggcaggtgggtctggggacagtgttcattcacaccatcagcagcctgcagtctagaagtatttgactaattttatacttgtacagtactagttaataattaacgtgggtaggtacgttacggaccgtaaaggggaacccaaagggtaaacgaaaacgttacgaaaacgaacgttaggtacggtaacgtacggacctaccgtaattccgtagtttacctttacc

SEQ ID NO: 442594 - DNA, 500 bp, Homo sapiens
  misc_feature: GZ8MTXP02F0ELQ.2.7.A07.1.454.CMB.2.raw
  modified_base (196)..(196): a, c, t, g, unknown or other
  modified_base (363)..(363): a, c, t, g, unknown or other
  modified_base (391)..(391): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccacagggccactggtactccagccaggttcagtggcagtgggtctggggacaggagttcatttcncaccatcagcagcctgcagtctgaagtntttgactaaatttattactgtcagcagtataatacgtggtgacgttcgacaaagggaccaaaggtacgaaaatcaaaacgaactgtaggctagacaccatctgtcttac

SEQ ID NO: 442595 - DNA, 622 bp, Homo sapiens
  misc_feature: GZ8MTXP02HAI17.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccacctctcctgcagggccagtcagagtattagcagcaacttagcctggtaccagcaagaaacctggccaggcctcccaggctcctcatctatgctgcactccgaccgacgggcctacgtcggtaactccccgaagtcccgtaacgggtttcacgggtcgggacgtagggttcggggtacgtgggggaacctaagggtacgtttccaacttttccgaccaaaccctatccgaaggcacgccctgcgtacgtctagtaagttattttagactttaaattttattacgttgtacagtactaagttaattaaatacgtggtaggtacgttacggacgtaaaacgggactaaagggtaaacaaagtacgaaaacgtaacgtggtacggaactacggaacctacctaagttccttacgttactttaccg

SEQ ID NO: 442596 - DNA, 506 bp, Homo sapiens
  misc_feature: GZ8MTXP02H7NY5.2.7.A07.1.454.CMB.2.raw
  modified_base (195)..(195): a, c, t, g, unknown or other
  modified_base (365)..(365): a, c, t, g, unknown or other
  modified_base (394)..(394): a, c, t, g, unknown or other
  modified_base (468)..(468): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaanagccacctctcctgcagggccagtcagagtattagcagcaacttagcctggtaccagcagaaacctggccaggctcccaggctcctcatctatgctgcatccaccagggccatggtactccccagccaggttcagtggcaggtgggtctgggggacaggagttcatttcncacccatcagcagcctgcagtctgaagtntttgacttaattttattactgtacagctaagtataatacgtggttggacgttcggacgaacgggacaaaggtanaaatacgaaacgaactgtggctgacacatctgtacttc

SEQ ID NO: 442597 - DNA, 531 bp, Homo sapiens
  misc_feature: GZ8MTXP02HIDTN.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggccactggtactcccagccaggttcagtggctaggtgggtctgggggactaggtacgttcatttcacaccatcagcagcctgcagtctagaagtattttgactaatttattactgtcagctagtaataatacgtggtaggtacgttcggaccgtaaagggaccaaagggttaacgaaattacgaaaacgtactggtaggaactggaccacctatcctagttcttc

SEQ ID NO: 442598 - DNA, 620 bp, Homo sapiens
  misc_feature: GZ8MTXP02IGSHH.2.7.A07.1.454.CMB.2.raw
  modified_base (372)..(372): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccacctctcctgcagggccagtcagagtattagcagcaacttagcctggtaccagcagaaacctggccaggctcccaggcctcctcatctatgctgcatccaccagggcccacgtggtactccccagccaggttcagtggcaggtggggtctgggggacaggtagtttcattcncaccatcagcagcctgctagtctagtaagtatttgacttaaattttattacgttgtacctagtactaagttaattaaagttaacgttaggggttacgggtaaccggtttaccggggaacccgtaaaacgggggtaccgtaaaaggggtaaacgtaaaaacgtaaccgtaaaaacggtaaaccgttagggttacgggaaccgttacggaaccttaacccgtaagtttaccttacggttacctttacccg

SEQ ID NO: 442599 - DNA, 509 bp, Homo sapiens
  misc_feature: GZ8MTXP02GMOYI.2.7.A07.1.454.CMB.2.raw
  modified_base (196)..(196): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccactggtactcccagccaggttcagtgcaggtgggtctggggacaggtagttcattcncaccatcagcagcctgcagtctagaagtatttgacttaaatttattactgtacagtctaagtataataacgtggtgacgttcgacgaagggaccaaaggtacgaaatacgaaaacgacgtgtagctgaccacatctcgtcttac

SEQ ID NO: 442600 - DNA, 574 bp, Homo sapiens
  misc_feature: GZ8MTXP02JRI48.2.7.A07.1.454.CMB.2.raw
  modified_base (197)..(197): a, c, t, g, unknown or other
  modified_base (252)..(252): a, c, t, g, unknown or other
  modified_base (282)..(282): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttgcctggtaccngcagaacctggccaggctcccaggctcctnatctatgctgcatcccacaggggccacgtcggtactccccagtccgaaggtttcaggtggcgtagggtgttcgtggggactagtcgttcattctcacatcagcagcctgctagtactagtagtattttgactaattttatactgtacagactaagttaataacgttacgtcggtacggtaaccgggttacgaaccggtaaaacgggtaaaccgtaaaggtaaaacgaaaacgttaaccgaaaacgtaaccgtgtcggctcgacctactactcgtttacgttacctttacccg

SEQ ID NO: 442601 - DNA, 593 bp, Homo sapiens
  misc_feature: GZ8MTXP02J1WXY.2.7.A07.1.454.CMB.2.raw
  modified_base (197)..(197): a, c, t, g, unknown or other
  modified_base (406)..(406): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtatagcagcaacttagcctggtaccagcagaaacctggccaggcctcccaggcctcctcatctatgctgcatcccaccgagggccacgtggtactcccagccaggttcagtggctaggtcgggtctggggacaggtagttcattctacaccatcagcacgcctgcagtctagaagttntttgacttaatttatactgtacagtactaagtaacttaaagtacgttgggtacggtaaccggttcgggaaccgtaaacgggggaaaccctaaaaggggtaacgtaaaaacgttacgaaaaaccggtaacgttcggttaacgggaaccttacggacctaaccgtactccgtttacgttcctttaaccg

SEQ ID NO: 442602 - DNA, 527 bp, Homo sapiens
  misc_feature: GZ8MTXP02JO40J.2.7.A07.1.454.CMB.2.raw
  modified_base (367)..(367): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccgagggccacgtggtactcccagccacggttcagtggcaggtggctggggacagtagttcattcncaccatcagcagcctgcagtctgaatatttgacttaatttatactgtacagctaagtaataataacgtggtaggtacgttacggacccgtaaaggggacctaaagggtaacgaaataccaaaacgtaactggtaggctaggacacgatcgtgtacttacg

SEQ ID NO: 442603 - DNA, 597 bp, Homo sapiens
  misc_feature: GZ8MTXP02HLTEF.2.7.A07.1.454.CMB.2.raw
  modified_base (407)..(407): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttagcctggtaccagcagaacctggccaggctccaggctcctcatctatgctgcactccaccgagggcccagtggtactccccgagcctaggttcaggtggctaggtgggtctgggggaactaggtagttcatttccacaccatcagcagcctgctagtctagtaatntttgacttaattttatacttgtacagtactaagttaattaaataacgttgggtacggtaccggtttacgggaaccgtaaaaggggtaccgtaaaggggttaaacgaaaacgttaaccgaaaacggtaacgttaggtacgggtaaccttacggaccctaacccgttattccgttacggtttacctttaccg

SEQ ID NO: 442604 - DNA, 525 bp, Homo sapiens
  misc_feature: GZ8MTXP02HW5L9.2.7.A07.1.454.CMB.2.raw
  modified_base (197)..(197): a, c, t, g, unknown or other
  modified_base (371)..(371): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctacagggccagtcagagtattagcagcaacttgcctggtaccagacagaacctggaccaggcctcccgaggcctcctcatctatgctgcatccaccgaggccacgtggtactcccagcctaggttccagtggcaggtggtctgggctagtagttcattcncacatcagcacgcctgctagtctagaagtatttgacttaatttatactgtcagtactagtaataatagtggtaggtacgttcgacgaacgggacaaaggtagaaactacgaaaacgtacgtagtagctaagacactactctcgttacttactac

SEQ ID NO: 442605 - DNA, 538 bp, Homo sapiens
  misc_feature: GZ8MTXP02JMHN8.2.7.A07.1.454.CMB.2.raw
  modified_base (196)..(196): a, c, t, g, unknown or other
  modified_base (361)..(361): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttgcctggtaccagcagaacctggccaggctcccaggctcctcatctatgctgcatcccaccagggccatggtactcccagccaggttcagtgcagtgggtctggggacagtagttcattcncaccatcagcagcctgcagtcagtaagtattttgactaaatttattactgtactagactaagtataagtaacgtggtggtacgtttacggacgtaaacggggacctaaagggtaacgtaaacgtaacgaaaacgtaacgtggtacgcgttacggacctaccgatcgtcgtacttacg

SEQ ID NO: 442606 - DNA, 556 bp, Homo sapiens
  misc_feature: GZ8MTXP02FVWJR.2.7.A07.1.454.CMB.2.raw
  modified_base (376)..(376): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatcccaccgagggcccacgtggtactcccagccaggttcaggtggctaggtgggtcgtgggggacaggtagttcatttcncaccatcagcagcctgcagtctagtaagtatttgacttaaatttattacttgtacagtactaagttaattaaataacgttgggtacggtacggtttcgggacgtaaacggggaccgtaaagggtaacgaaaatacgaaaacgtaacgtggtaggcgtcgacacctattcgtcgtctttac

SEQ ID NO: 442607 - DNA, 503 bp, Homo sapiens
  misc_feature: GZ8MTXP02FEZ9N.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctccccaggctcctcatctatgctgcatccaccagggccactggtatcccagccaggttcagtggcagtgggtctggggacagagttcattctcaccatcagcagcctgcagtctgagattttgactaatttattactgtcagcagtataataacgtggtggacgttcggaccaaagggaccaaaggtaagaaaatacaaaacgaactgtaggctgacacatactgtctttac

SEQ ID NO: 442608 - DNA, 526 bp, Homo sapiens
  misc_feature: GZ8MTXP02GNTYA.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccaggctcctcatctatgctgcactcccaccagggccacgtggtactcccagccaggttcagtggcaggtgggtctgggggacaggtagttcattcctacaccctatcagcacgcctgcagtctagaagtatttgactaatttattactgtcagtctaagtataatacgtggtaggtacgttcggacgaagggaccgaaaggtaacgaaatacgaaaacgtacgtgtagcgtgacactatctacgtcttac

SEQ ID NO: 442609 - DNA, 517 bp, Homo sapiens
  misc_feature: GZ8MTXP02HBC11.2.7.A07.1.454.CMB.2.raw
  modified_base (197)..(197): a, c, t, g, unknown or other
  modified_base (344)..(344): a, c, t, g, unknown or other
  modified_base (351)..(351): a, c, t, g, unknown or other
  modified_base (363)..(363): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagccctggtaccagcagaacctggccaggctcccaggctcctcatctatgctgcatcccacagggccacgtggtactcccagccaggtcagtgcagtgggtcnggggacnggagttcattcncaccatcagcagccctgcagtctagaaagtctttgactaatttatactgtacagtcagtataatactggtagacgttcggaccgtaaagggaccaaaggtacgaaaactactaaaacgaactggtacggctacgactaccatcctagtctttac

SEQ ID NO: 442610 - DNA, 551 bp, Homo sapiens
  misc_feature: GZ8MTXP02FVCZ3.2.7.A07.1.454.CMB.2.raw
  modified_base (197)..(197): a, c, t, g, unknown or other
  modified_base (382)..(382): a, c, t, g, unknown or other
  modified_base (386)..(386): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttgcctggtaccagcagaacctggccaggcctccaggcctcctcatctatgctgcatcccaccgacgggcccacgtggtactcccagcctaggttcaggtggctaggtcgggtcgtggggacaggtagttcattctacactntcancagcctgcagtctagatagtttgacttaaatttattactgtacagtactaagtaataattaacgtgggtagtacggttcggacgtaaacgggacgtaaagggttaacgaaataacgaaaacgtaactggtacgaacgtacgacacgtatacgtacgttacttacg

SEQ ID NO: 442611 - DNA, 603 bp, Homo sapiens
  misc_feature: GZ8MTXP02FZT3X.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaaacctggccaggcctcccaggcctcctcatctatgctgcactcccaccgagggcccacgttcggtaactccccgagccctagggttccaggtcggcctagggttcggggtctgggggactaggtacgttcatttcaccaccatcagcagccctgctagtctagaagttatttgacttaatttattacgtgtacagtactaagttaataagtaacgttgggtacggtacggtttacgggaaccgtaaaggggtaacctaaaaggggttaaacgaaaacgttacgaaaaacggtaacgttggtacggaactacggacctacctattccgtacgttacctttacg

SEQ ID NO: 442612 - DNA, 545 bp, Homo sapiens
  misc_feature: GZ8MTXP02JMX9C.2.7.A07.1.454.CMB.2.raw
  modified_base (195)..(195): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaangccacctctcctgcagggccagtcagagtattagcagcaacttagcctggtaccggcagaaacctggccaggctcccaggctcctcatctatgctgcatccaccagggcccacgtggtactccccagcccaggttcccagtggctaggtggggtctggggcaggagtttcatttctacaccatcagcagcctgcagtctgtaagtattttgacttaaatttattaactgttacagactaagttaataataacgtggtaggtacgttacggaccgaaaagggacctaaagggtaaagaaactacgaaaacgaacgtacgtaggactaagacaaccatcgtacgttctctac

SEQ ID NO: 442613 - DNA, 645 bp, Homo sapiens
  misc_feature: GZ8MTXP02H7MRB.2.7.A07.1.454.CMB.2.raw
  modified_base (198)..(198): a, c, t, g, unknown or other
  modified_base (266)..(266): a, c, t, g, unknown or other
  modified_base (274)..(274): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaaanacgccaccctctcctgcgagggccagtcagagtattagcagcaacttagcctggtaccagcagaaccngccaggcncccagcctcctcatctatgctgcactccccaaccgaggggaccctaacgtcggtaacctacccccgaggccctaagggttccaagggttcggacgtagggttcggggtaccgttgggggaaacctaaggtacgttttcctaagtttccctacaacccataccagccacgccctgctagtactagtaagttatttagaactttaatttttacttacgttagtctaagtactaaagttaaataaagttaacgtgggttacggtaaccggttcgggaaaccgtaaaaggggaaaccgtaaaggtaaagaaaacgtaacgaaaaccgtaacgttggtacggaactcgaacctacctaatttcctacgtttctacc

SEQ ID NO: 442614 - DNA, 530 bp, Homo sapiens
  misc_feature: GZ8MTXP02JJHWV.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatcccaccagggccacgtggtactcccagccaggttcagtgcagtggctggggacaggagttcattctcaccatcagcagcctgcagtctagaagtatttgactaatttattacttgtctagactagtaataataacgtggtggtacgttacgaccgtaaacgggaccgaaggtaacgaaagtacgaaacgtaaacgtggtacgcgtacgaccgaccattactacgttcttacg

SEQ ID NO: 442615 - DNA, 634 bp, Homo sapiens
  misc_feature: GZ8MTXP02HWIX8.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccaggctcctcatctatgctgcatcccacagggccacgtggtatccccagccaggttcagtggctaggtggggtctgggggactaggtacgtttcgatttccgtacaacccatcaagcaggtccctagcaggttactaggtaaagttacttttagactttaaatttttacttaccgttgtacctaaggtacctaaagttaattaaaagttaacggttgggttacggtaaccggtttaccggggaacccgtaaaaggggtaaacccgtaaaggggtaaacgaaaacgttacgaaaaccggtaacgttagggtacggaacttacggacctaaaccgtctttaccgttcgtttacctttaccg

SEQ ID NO: 442616 - DNA, 556 bp, Homo sapiens
  misc_feature: GZ8MTXP02IO41Z.2.7.A07.1.454.CMB.2.raw
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagccctggtaccagcaagaacctggccaggcctcccgaggctccncatctatgctgcatccaccagggccagtggtactcccagcctaggttcagtcggcaggtgggtctgggggacaggtagttcattcacaccatcagcagcctgacagtactagtaaagtatttgacttaattttacttacttgtcagactaagttataaatacgttggtacggtacgttcggaccgtaaacggggactaaagggtacgtaaaactacgaaaacgacttggtacgaacgttacgacctaccagttaccttcgttacttacg

SEQ ID NO: 442617 - DNA, 499 bp, Homo sapiens
  misc_feature: GZ8MTXP02JQUG5.2.7.A07.1.454.CMB.2.raw
  modified_base (395)..(395): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtggcagtgggtctggggacaggagttcattctcacccatcagcacgcctgcagtctagaagtntttgactaattttatactgtcagcaagtataatacgtggtagacgttcggacgaagggacaaggtagaatacaaacgactgtaggctgacaccatctgtcttac

SEQ ID NO: 442618 - DNA, 596 bp, Homo sapiens
  misc_feature: GZ8MTXP02HX00B.2.7.A07.1.454.CMB.2.raw
  modified_base (197)..(197): a, c, t, g, unknown or other
  modified_base (384)..(384): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaacctggccaggcctcccaggcctcctcatctatgctgcactcccaccgagggccacgtggtactccccgagcctaggttcaggtggctaggtggggtctgggggactaggtacgttctatttccncacccatcagccagccctgacctagtctagtaagtattttagacttaaattttacttacttgtacagtactaagtaataagttaacgtgggttacggtacgttacgggtaccgaaacggggtacctaaaggggttaaacaaaagttaccgaaaacgtacgttaggtacggtaaccgtacggacgtaccctagttccgttcgtttacctttac

SEQ ID NO: 442619 - DNA, 728 bp, Homo sapiens
  misc_feature: GZ8MTXP02JYGVZ.2.7.A07.1.454.CMB.2.raw
  modified_base (195)..(195): a, c, t, g, unknown or other
  modified_base (232)..(232): a, c, t, g, unknown or other
  modified_base (292)..(292): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaanacgccaccctctcctgcagggccagtcagagtatagnagcaacttagcctggtaccaggcaagaacctgcccaggcctccaggcctcctcatctatnctgcactcccaccgagggcccagtcggtactccccgaggccctaagggttcaggtcggacgtagggttcggggtcctgggggaccaagggttacgttccaagtttcccctactaacccgaagttcccgaacggaccctaaccggtccccttagggacccgttaaacggttcgttaaacggggttaaaacgttttatttttacggaaaccttttaaagtttttaaaccgtttaccgttaggttaaccaagggttacctttaaaacggtttaaagtttaaacgttaaaccgggttagggggtttaaccgtacccggggtttaaacccggggaaacccgttaaaacggggaacccgtaaaaagggttaccgaaaaacgttacgaaaaacccgtgtacggtacggaacctacgacccaacgtacttcgtacttctaaccg

SEQ ID NO: 442620 - DNA, 514 bp, Homo sapiens
  misc_feature: GZ8MTXP02GO2H9.2.7.A07.1.454.CMB.2.raw
  modified_base (368)..(368): a, c, t, g, unknown or other
  modified_base (397)..(397): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatcccaccagggcccatggtactcccagccaggttcagtggcaggtgggtctggggacagtagttcatttcncaccatcagcagcctgcagtctagaagtnttttgacttaatttattactgtcagctagttataataacgtggtggtacgttacggacaagggaccaaaggtaacgaaacgtacaaaacgactgtaggctgactacatcgtgtctac

SEQ ID NO: 442621 - DNA, 615 bp, Homo sapiens
  misc_feature: GZ8MTXP02ISJFZ.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtatagcagcaacttagcctggtaccagcagaaacctggccaggcctcccaggctcctcatctatgctgcactcccaccgacgggccacgtcggtactccccgagtccctagggttccaggtcggctagggtcgggtctgggggactagggtcgtttccattccgtaccacctatcacgcacgcctgcagtctagaagtatttgacttaaattttattacgttgtactagtactaagttaattaaacgttaacgttagggttacgggtaaccggttacgggaacccggtaaaacggggacccgtaaaaggggtaacgtaaaaacgtacgtaaaacgtaacgtaggtacgggtaactacggacctaaccgtatcttacgttacctttac

SEQ ID NO: 442622 - DNA, 531 bp, Homo sapiens
  misc_feature: GZ8MTXP02JBJMT.2.7.A07.1.454.CMB.2.raw
  modified_base (196)..(196): a, c, t, g, unknown or other
  modified_base (363)..(363): a, c, t, g, unknown or other
  modified_base (476)..(476): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccacagggccactggtactcccagccaggttcagtgcaggtgggctggggacaggagttcatttcncaccatcagcagcctgcagtctagaagtatttgactaatttatactgtctagactagtataaataacgtggtaggtacgttacggacgtaaaacggggacctaaagggtaaanaaagttaacaaaacgtaacgtggtaggaactacggacacctatcctgtactttac

SEQ ID NO: 442623 - DNA, 570 bp, Homo sapiens
  misc_feature: GZ8MTXP02FPTGI.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatccacacgggccacgtgtactcccagccaggttcagtgcagtgggctggggacaggtagttcaagtttcacacctatcaacgcacgcctgcagtctagaagtatttgactaaatttattactgtctaaggactagtaataaacgttaactggggtagtacgttcgggaacccgaaaaggggtaaccctaaaaggggttaaacgaaaaagttaccaaaaaccggtaacgttggtaagggaacttacggaccaacctataccctgtcctttaacc

SEQ ID NO: 442624 - DNA, 546 bp, Homo sapiens
  misc_feature: GZ8MTXP02ITVMC.2.7.A07.1.454.CMB.2.raw
  modified_base (393)..(393): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtggcaggtggtctggggacaggagttcattctcaccatcagcagcctgcagtctggaaatntttgacttaaattttattacttgtacagctaagttactaagtacgttgggtaggtacgtttcggacccgtaaaggggaccaaaggggttaacgaaaacttacgaaacggtaaactggtacggctaggaccaccgtatactcgttacctttacg

SEQ ID NO: 442625 - DNA, 586 bp, Homo sapiens
  misc_feature: GZ8MTXP02HNMNJ.2.7.A07.1.454.CMB.2.raw
  modified_base (369)..(369): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtattagcagcaacttagcctggtaccagcagaaacctggccaggctccaggctcctcatctatgctgcatccacgacgggccactggtactcccagccaggttccagtcgcaggtggggtctggggacaggtagttcagttcncaccatcagcacgccctgactggtctagtaacgtattttgactttaaattttattacttgtctaagtctaaagttaacttaaagtaacgttgggtaggtaaccggtttcggaacccggtaaaaggggaacccgtaaaagggtaaacgtaaaacgttaccgaaaacgtaaacgttgtaacggccgtacggacctacgatttacgtacgtttactaacc

SEQ ID NO: 442626 - DNA, 549 bp, Homo sapiens
  misc_feature: GZ8MTXP02GLIKF.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggctcccaggctcctcatctatgctgcatccacagggccacgtggtactcccagccaggttcagtgcagtgggtctggggacagtagttcattctcaccatcagcagcctgcagtctagaagtatttgacttaaatttattactgtacagtctaagttaataattacgtgggtaggtacgttacggaccgtaaaggggacctaaagggtaacgaaaactaccgaaaacgaacgttaggtaggctacggacctaacctattaccgtcgttacctttaccg

SEQ ID NO: 442627 - DNA, 537 bp, Homo sapiens
  misc_feature: GZ8MTXP02I27X0.2.7.A07.1.454.CMB.2.raw
  modified_base (283)..(283): a, c, t, g, unknown or other
  modified_base (361)..(361): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctccncatctatgctgcatccaccagggccagtggtactcccagccaggttcagtgcaggtggctggggacagagttcattcncaccatcagcagcctgctagtctgaagtatttgacttaatttattactgtacagtacaagttataataacgtgggtaggtaacgttcggacgaaacgggaccaaagggtaacgaaaacgtacgtaaaacgaacgttggtacggaacgtacggacaaccatccgtacgttacttacc

SEQ ID NO: 442628 - DNA, 655 bp, Homo sapiens
  misc_feature: GZ8MTXP02H9DW3.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccgaaggggaaanacgcccaccctctcctgcgagggccagtcagagtatagcagcaactagcctggaccagcagaaacctggccaggcctcccaggcctcctcatctatgctgcactcccaccgagggccacgtggtactccccagtcctaggttcaggtcggacgtaggttcggggtctggggaactaggtacgtttccaagtttccactaacccatcaagcacgccctagctacgtctaggtaagttattttacgactttaaatttttacttaacgttcggttacaaggtacttaaggttaaattaaaacgttaaacggttggggttaacgggtaccgggtttaccgggaaaccggttaaaacgggggaaccttaaaagggggtaaaactaaaacggtaaccgtaaaaaccggtacttaagggtacggaacgttacgaccttaccgtaattccgttacgtttaccttac

SEQ ID NO: 442629 - DNA, 579 bp, Homo sapiens
  misc_feature: GZ8MTXP02JUQX7.2.7.A07.1.454.CMB.2.raw
  modified_base (196)..(196): a, c, t, g, unknown or other
  modified_base (280)..(280): a, c, t, g, unknown or other
  modified_base (324)..(324): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggcaggctccagctcctnatctatgctgcatccacagggccatggtactcccagccaggttnagtggctaggtgggtctgggggacaggtacgttcagtttctacgaaccctatcagcagccctgcagtctagaagttattttgacttaatttagttgtacttggtacaaggtactaagttaataaattaacgtgggttacggtacggtttcgggaaccgtaaacggggaacccgaaaagggttaaacgaaaacgtaacgaaaaacggtacgttaggtaaggaccgtaggaccctacgtacttaccgtgtttaaccc

SEQ ID NO: 442630 - DNA, 527 bp, Homo sapiens
  misc_feature: GZ8MTXP02JITM3.2.7.A07.1.454.CMB.2.raw
  modified_base (195)..(195): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaanagccaccctctcctgcagggccagtcagagtattagcagcaacttagcctggtaccagcagaaacctggccaggctccccaggctcctcatctatgctgcatcccaccagggccactggtactcccagccaggttcagtgcagtgggtctggggacagagttcattcacaccatcagcagcctgcagtctgaagtatttgactaatttatactgtcagtcagtataataactggtaggtacgttcggacgtaaacgggaccgaaaggttaacgaaagtaccgaaaacgtaacgtggtacggctacggaccacctagtctacgttacttaccg

SEQ ID NO: 442631 - DNA, 590 bp, Homo sapiens
  misc_feature: GZ8MTXP02HEUE7.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcagaaacctggccaggcctcccgaggcctcctcatctatgctgcactccaccgagggccacgtggtactcccagccaggttcagtgcaggtggtctggggacaggacgttcattcacaccatcagcacgccctgctagtctagtaagtattttgacttaattttatacttgtactagtactaagttaataaacgttaacgttgggtacggtaaccggtttacgggaaccgtaaaacgggggtaccctaaaaggggttaaacgaaaaacgtaccgaaaaacggtaacgtaggttacggaacgtacgacccgtaacctacttccttacgttactttaccg

SEQ ID NO: 442632 - DNA, 531 bp, Homo sapiens
  misc_feature: GZ8MTXP02ISGKK.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccacctctcctgcagggccagtcagagtattagcagcaacttagcctggtaccagcagaaacctggccaggctccccaggctcctcatctatgctgcatccaccgagggccactggtactcccagccaggttcagtggcaggtgggtctggggacagtagttccattctcacctatcagcagcctgcagtctagtaatatttgacttaattttatacttgtacagctaagttataaattaacgtgggtggtacgttcggaccgtaaagggaccgtaaagggtacaaaagttacaaaacgtactgtaggtctcgacacctagtctcgttacttc

SEQ ID NO: 442633 - DNA, 510 bp, Homo sapiens
  misc_feature: GZ8MTXP02HDQ9D.2.7.A07.1.454.CMB.2.raw
  modified_base (361)..(361): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccatggtatcccagccaggttcagtgcagtgggtctggggacaggagttcattcncaccatcagcagcctgcagtctagaagtattttagactaaatttattactgtcagtacaagtataactaatggtaggacgttcggaccgaaagggaccaaaggtacgaaaatacgaaaacgaactgtagctgacaccatctgttacttc

SEQ ID NO: 442634 - DNA, 549 bp, Homo sapiens
  misc_feature: GZ8MTXP02F6V92.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcactcccaaccgagggcccacgtcggtactccccgagcctaggttcagtggcaggtggggtctgggggacaggtacgttcattctacacctatcagcagcctgcagtctagagtatttgacttaatttattactgtacagtactaagtaataaataacgtgggtagtaacgttcggacgaaacggggacctaaaggtaacgaaaactacgaaaacgtaacgtggtacggctagacaccgtatctacgtcttacc

SEQ ID NO: 442635 - DNA, 581 bp, Homo sapiens
  misc_feature: GZ8MTXP02I9613.2.7.A07.1.454.CMB.2.raw
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggctcccaggctcctnatctatgctgcatcccaccgagggccacgtcggtactcccagccaggttcagtggcaggtgggtctggggacaggtagttcattctacaccatcagcacgcctgcagtctagaagtatttgacttaaatttattactgtacagtactaagtaattaaagtaacgttgggtaggtacgttacggaaccgtaaaacgggggtaacctaaaagggtaaacgtaaaacgtacgtaaaaacggtaaacgttggtaacgggaacctacggaacctaacctatccgttacgtttacctttaccg

SEQ ID NO: 442636 - DNA, 607 bp, Homo sapiens
  misc_feature: GZ8MTXP02IFH5J.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtattagcagcaacttacgcctggtaccagcaagaacctggccaggctcccaggcctcctcatctatgctgcatcccaccgagggcccacgtggtactccccagcctaggttcagtggcaggttcggggctgggggacagggtagtttcatttcacaccatcacgcacgccctgcagtcgtagtaagtatttgacttaaatttattacttgtacagtactaagttataagtacgttgggtacggtaccggttacgggaaccgtaaacggggtaaaccgtaaagggtaaacgtaaaacgtaaacgaaaaccggtaaacgttcggttaacggaaccgtacggtacctaaacccggtactttcccgttaagtttccctttaaccg

SEQ ID NO: 442637 - DNA, 511 bp, Homo sapiens
  misc_feature: GZ8MTXP02GGYPD.2.7.A07.1.454.CMB.2.raw
  modified_base (196)..(196): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctccaggcctcctcatctatgctgcatccaccagggccactggtactcccagccaggtcagtggcaggtgggtctggggacaggtagttcattcncaccatcagcagcctgcagtctagaatatttgacttaaatttatactgtacagtctaagtataatacgtggtgtacgttcggacaagggacaaggtaacgaaatacaaaacgacgtgtaggaactacgacacctatctacgtctac

SEQ ID NO: 442638 - DNA, 602 bp, Homo sapiens
  misc_feature: GZ8MTXP02HO2KH.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaacctgccaggctccaggctcctcatctatgctgcatccacgagggccagtggtactccccagcccgtaggttcaggtcggctaggtcggggtctgggggactaggtacgtttcagttcctaccaaccctatccgaggcaacggcccttgacctaggttcctaggtaagttacttttagacttaattttattacgttgtactagtactagttaataagtacgtgggttacggtaccgtttacgggaaccgtaaacggggtaacctaaagggtaaacgaaaacttaccgaaaaacgtaccgttaggtacggaacgtacggacctaccgattccttacgtacctttac

SEQ ID NO: 442639 - DNA, 556 bp, Homo sapiens
  misc_feature: GZ8MTXP02J19BP.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagcctggtaccagcagaaacctggccaggcctcccaggcctcctcatctatgctgcatccaccaggggccacgtggtactccccagcccagggttccaggtcggctaggtggggtctgggggactaggtagttcattctacacccatcagcagccctgcagtctagaagtattttagacttaaatttattactgtacagtctaagtattaaataacgtggtaggtacgttacggaccgaacggggaaccaaagggtaacgaaaatacgaaaacgaacgttggtaggcgtacgacaccctatccttacgtctttacc

SEQ ID NO: 442640 - DNA, 625 bp, Homo sapiens
  misc_feature: GZ8MTXP02JK5EZ.2.7.A07.1.454.CMB.2.raw
  modified_base (197)..(197): a, c, t, g, unknown or other
  modified_base (257)..(257): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcgacgggccagtcagagtattagcagcaacttagcctggtaccngcagaacctggccaggctcccaggcctcctcattctatcgctgccactcccaccgacgggcctacgtggtaactcccaggcctaggttcaggtggctaggtgggtctggggacaggtagttccagttctcacctatcacgcgacgcctgctacgtctaggtaagtacgtttgtactaaagttttattacgttgtactaggactaagtaagtaacttaacgtagggtacggtaccggtttacgggaccgtaaaacggggtaaccgtaaaagggttaacggaaaacttaaccggtaaaacggtaaaccgttagggtacggtaacgttacggaccctaaccgtaacgtttcctacggttaccctttaaccg

SEQ ID NO: 442641 - DNA, 553 bp, Homo sapiens
  misc_feature: GZ8MTXP02JF509.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggctcccaggctcctcatctatgctgcatccaccacgggccactggtactcccagccaggttcagtcggcaggtgggtctgggggacaggtacgttcagtttctacacctatcaagccagcctgcagtctagtaagtatttgacttaatttattactgtcagtactagttataactaacgtggtacggtacgttcgggaccgtaaaggggaccgaaagggtaacgaaaacgttacgaaaacgtaacgtggtacgcgtacggacctaccataccttcgtacttacg

SEQ ID NO: 442642 - DNA, 826 bp, Homo sapiens
  misc_feature: GZ8MTXP02I1ZRD.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagcccaccctctcctgcgagggccagtcagagtattagcagcaacttagcctaggtaccagcaagaaaccgtggaccaggcctaccccgaggcctccctacacttctatcgcctgacctactacccgaaccgacggggccctaacgttcgggtaacctacccccgaaggtcccgtaaccggggtttaccaagggtttcgggaccgtaggggttcggggttccgtaggggggaacctaaggggttacggttttaccgaacttttcccgtaccaaacccgtaacttcccgaaaggtcccaaacggtcccccgttagggaccctacggtttaccgtagggttaaaacgttatttttaggtaaccttttaaaatttttaacgtttaaccgttgttaccgtaaaggttacctaaaggtttaaaacttaaaaggtttaaaccgggtttagggggtaaccggggtttaaacccgggtttacccggggaaacccggtaaaaacgggggtaaacccgttaaaaagggggttaaacgtaaaaaacgttaaccggaaaaacccggttaaacgttgggtaacgggtaaccgttacggaacccgtaaacctacgtttaccgttacggtttaccctttaacccg

SEQ ID NO: 442643 - DNA, 557 bp, Homo sapiens
  misc_feature: GZ8MTXP02IK3GV.2.7.A07.1.454.CMB.2.raw
  modified_base (371)..(371): a, c, t, g, unknown or other
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatccaccagggccactggtactccccagccaggttcagtcggcaggtggggtctgggggacaggtagttcagtttcncaccatcagcacgcctgcagtctgaagtntttgactaatttattacttgtcagtactagtataagttacgtggtagtacgttcggaccgtaaaggggaccgtaaagggtacgtaaaacgtaacgaaaacgtaaaccgttggtacgggtaacttacggacaaccctattccgtttacgtctttaccg

SEQ ID NO: 442644 - DNA, 601 bp, Homo sapiens
  misc_feature: GZ8MTXP02HE598.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggcctccccgaggcctcctcatcctatcgctgcactccaccgagggccctacgtcggtactccccgagcccgtaaggttccaggtcggctagggtcgggtctgggggacagtagttcatttcacaccatcagtcagctgctagtctagaagtatttgacttaaagttttacttacgttgtaccgtaagacctaaaggtattaaagtacgttagggttacggtacgttacgggacctaaaacggggtaaccctaaagggtaaactaaacgttaccggaaaaacgtaacgttggtacgaacgtcgaacctaccgtaatccgtacgtttactcc

SEQ ID NO: 442645 - DNA, 569 bp, Homo sapiens
  misc_feature: GZ8MTXP02HNMC1.2.7.A07.1.454.CMB.2.raw
  modified_base (196)..(196): a, c, t, g, unknown or other
  modified_base (344)..(344): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcaagaaacctgccaggctccaggctcctcatctatgctgcatccaccgagggcccagtgtactcccagccacggtcagtgcaggtgggtcnggggacaggtagttcattctacaccatcagcagccctgacacgttctagaagtatttgacttaaatttattacttagtctagtactaagtaattaaataacgtggtacggtaacggttcggaaccggaaaacgggtaccgtaaaagggtaaagaaaacgttaaacgaaaacgtaacgtagttacgggaactagaccaacctaattccgtacggtttactttaccc

SEQ ID NO: 442646 - DNA, 564 bp, Homo sapiens
  misc_feature: GZ8MTXP02GQTAJ.2.7.A07.1.454.CMB.2.raw
  modified_base (98)..(98): a, c, t, g, unknown or other
  modified_base (280)..(280): a, c, t, g, unknown or other
  modified_base (361)..(361): a, c, t, g, unknown or other
tcagacgctcgacacacgaccggtgctcgatttagcacgtgtcgcagggggaggaactgctcagttaggacccagacggaaccatggaagccccagcncagcttctcttcctcctgctactctggctcccagatgccactggagaagtggtgatgacgcagtctccagccaccctgtctgtgtctccgagggggaaagagccaccctctcctgcagggccagtcagagtattagcagcaacttgcctggtaccagcagaacctggccaggctccagctcncatctatgctgcatccacagggccactggactcccagccaggttcagtggcaggtgggtctggggacaggtagttcattcncaccatcagcacgctgcagtctagaagtactttgacttaaagttttattacttgttcagtactaagtaataagtaacgttgggttacgtacggttacggacgtaaacggggaaccctaaaggggtaacaaaacgtacgtaaaaacgtaacgttaggtacggaacgttacggaccgtacctaataccgttcggttactttaccg

SEQ ID NO: 442647 - DNA, 641 bp, Homo sapiens
  misc_feature: GZ8MTXP02GYB47.2.7.A07.1.454.CMB.2.raw
  modified_base (197)..(197): a, c, t, g, unknown or other
  modified_base (450)..(450): a, c, t, g, unknown or other
tcagacgctcgacacacgaccggtgctcgatttagcacgtgtcgcagggggagggaactgctcagttaggacccagacggaaccatggaagccccagcgcagcttctcttcctcctgctactctggctcccagatgccactggagaagtggtgatgacgcagtctccagccaccctgtctgtgtctccgaggggaanagcccaccctctcctgcagggccagtcagagtattagcagcaacttagcctggtaccagacaagaaacctggccaggcctacccgaggcctcctacatctatgctgccactcccaccgagggcccaacgtcggtacctccccgaaggtccctagggtttccaggttcgggacctaggggttcggggtctgggggaacagggtacgtttccatttccaccaacctatcagcacgcctgacagtctagtaagttntttagacttaatttattactgtacagtacaagttataaacttagtagggtacggtaccgttacgggaaccctaaagggggaaacctaaagggttaaacgaaaacgttaaaccgaaaaacggtaacgtttacggagggtaaccgtacggaaccctaaacccgtagtttccttacggtttaccctttaacccg

SEQ ID NO: 442648 - DNA, 525 bp, Homo sapiens
  misc_feature: GZ8MTXP02IKBBL.2.7.A07.1.454.CMB.2.raw
  modified_base (197)..(197): a, c, t, g, unknown or other
  modified_base (367)..(367): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagngccaccctctcctgcagggccagtcagagtattagcagcaacttagcctggtaccagcaagaacctggccaggctcccaggctcctcatctatgctgcatccaccagggccactggtactccccagccaggttcagtggcaggtgggtctgggggacaggagttcattcncaccatcagcagcctgcagtctagtaagtatttgacttaattttattactgtcagtacagttataatacgtggtggtacgttcgggacgtaaacgggacctaaggtaacgaaactacgaaacgaacgtgtaggcgtacgacactatcttacgtcttac

SEQ ID NO: 442649 - DNA, 594 bp, Homo sapiens
  misc_feature: GZ8MTXP02IOTE5.2.7.A07.1.454.CMB.2.raw
  modified_base (196)..(196): a, c, t, g, unknown or other
  modified_base (403)..(403): a, c, t, g, unknown or other
  modified_base (418)..(418): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcaagaaacctggccaggctcccaggcctcctcatctatgctgcactccaccgagggcccacgtggtactcccagccaggttcagtggcaggtgggtctggggacagtagttcatttcactaccatcagcagcctgctagtctagaagtntttgacttaaatttntaactgtacagtactaaagttataaacttacggtggggttacggtaaaccggtttccgggaacccgtaaaaagggggtaaccctaaaaggggttaaagaaaaacttaaccgaaaaaccgtaaacgtttgggacgtaaccgtacgaaccacgtaattccgttacgttactttacccg

SEQ ID NO: 442650 - DNA, 610 bp, Homo sapiens
  misc_feature: GZ8MTXP02GU3I1.2.7.A07.1.454.CMB.2.raw
  modified_base (403)..(403): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcaagaaacctggccaggctcccgaggcctcctcatctatgctgcatccaccagggcccacgtggtactcccagccaggttcagtggcaggtcgggtctggggacaggtgttcagttcacaccatcagcagcctagcagtctagtaagtntttagacttaatttattacttgtacagtactaagttaataaacttaacgtgggttacggtaccggtttacgggaacccgtaaaacgggggtaaccctaaaggggtaaaacgtaaaacgtaacccgtaaaaacgtaaaccgttagggtacggggtaaccttacgggaacctaacccgtaacgtttaccgtcggtttacctttaacccg

SEQ ID NO: 442651 - DNA, 556 bp, Homo sapiens
  misc_feature: GZ8MTXP02HKH64.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaacctggccaggcctcccaggcctcctcatctatcgctgcactccaccgagggcgactggtactcccagccaggttcaggtggctaggtggggtctgggggacaggtacgtttcagtttccaccaacccatccagcacgcctgctagtctagtaagtatttgacttaattttattacttgtacagtactaagtataataacgtggtaggtacgttcggaccgtaaacgggaccgtaaggtaaacgaaaatacgaaaacgtacgtggtacgaacgtgaccacctagtcctacgttcttac

SEQ ID NO: 442652 - DNA, 530 bp, Homo sapiens
  misc_feature: GZ8MTXP02JFKPA.2.7.A07.1.454.CMB.2.raw
  modified_base (479)..(479): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatccacagggccatggtatcccagccaggtcagtgcaggtgggtctggggacagtagttcattctcaccatcagcagccctgcagtctagtaagtattttgacttaaattttattaacttgtacagtactaagtataaagtaacgtggtaggtacgttcggaccgtaaacgggaccaaagggtanaaaattacgaaacgtaacgtgtaggaactcgacacctatcctgttcttacc

SEQ ID NO: 442653 - DNA, 526 bp, Homo sapiens
  misc_feature: GZ8MTXP02F6ADI.2.7.A07.1.454.CMB.2.raw
  modified_base (285)..(285): a, c, t, g, unknown or other
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctnatctatgctgcatccaccagggccacgtggtactcccagccaggttcagtggcagtgggtctggggacagagttcattcncacatcagcagcctgcagtctagaagtatttgactaatttatactgtcagctaagtataaatacgttggtagtacgttcggacgtaaacgggaccaaagggtaaacaaacgtacgaaaacgtacgtggtacgaacgtacgaccactatcgtacgttctacg

SEQ ID NO: 442654 - DNA, 523 bp, Homo sapiens
  misc_feature: GZ8MTXP02F14SC.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtgcagtggggtctggggacagagttcattctcaccatcagcagcctgcagtctagtaagtatttgactaatttattactgtctagtacaagtataataacgttgggtaggtacgttcgggacctaaacggggaccgaaaggtaacgaaaatcgaaaacgtactgtaggctaggacacctatctcgtacttc

SEQ ID NO: 442655 - DNA, 531 bp, Homo sapiens
  misc_feature: GZ8MTXP02G5HCV.2.7.A07.1.454.CMB.2.raw
  modified_base (196)..(196): a, c, t, g, unknown or other
  modified_base (401)..(401): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcaagaacctggccaggctcccaggcctcctcatctatgctgcatcccaccacggggccatcggtactcccagccaggttcagtggcaggtgggtctggggacaggtacgttcatttcacaccatcagcacgcctgcagtctagtaaatnttttgacttaatttatacttgtcagtacagttaataaactaagtgggtacggtacgttacgggaccgtaaaacggggtacaaaggtaacgaaactacgaaaacgaactgtagctagcactatctgtactc

SEQ ID NO: 442656 - DNA, 577 bp, Homo sapiens
  misc_feature: GZ8MTXP02GG0ZK.2.7.A07.1.454.CMB.2.raw
  modified_base (321)..(321): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggaccagcaagaaacctggccaggcctccgaggcctcctcatcatgctgcactcccacgagggccagtgtacncccgagcctaggttcagtgcaggtcgggtcgtggggacaggtacgtttcacgtttcacacctatcacgcacgcctgacagttcgtagtaagttactttgaactttaaattttacttactgtactaagtctaaagttaattaaactaaggtggttagggtaaccgtttaccgggaacgtaaacggggaaacctaaagggttaaagaaaactaacgaaaacgtaacgtggtagaactcgacactatcgtcgtcttacg

SEQ ID NO: 442657 - DNA, 592 bp, Homo sapiens
  misc_feature: GZ8MTXP02G0YYC.2.7.A07.1.454.CMB.2.raw
  modified_base (197)..(197): a, c, t, g, unknown or other
  modified_base (303)..(303): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaaacctggccaggctccaggctcctcatctatgctgcatcccacncgggccacgtcggtactcccagccaggttcagtggctaggtgggtctggggacaggtagttcagttctcacctatcagcacgcctgctagtctagtaagtatttgactaaattttatacttgtactagtactaagttataaatacgtgggtacgtacggttacggacccgtaaagggtaaccgaaaggggtaaacgtaaaacgtaaccgtaaaaacggtaaaccgttgggtaacgggtaacgttacggacccgtaacccgtatttccgtttaacggtttctttaacccg

SEQ ID NO: 442658 - DNA, 586 bp, Homo sapiens
  misc_feature: GZ8MTXP02IZGLE.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaaacctggaccaggcctcccgaggcctcctcatctatgctgcactcccaccgacgggcccacgtcggtactccccgagcctaggttcaggtcggactaggtcgggtctgggggactaggtacgtttcagtttccacacctactcagcagtcctgctagtctagtaagtatttcgacttaaatttattactgtacagtactaagttaataagtaacgttgggtacggtacggttacggaaccgaaagggtaccgtaaagggtaaacgaaacgtacgaaaacgaacgtggtacgaacgtacgacctaccgtataccgttcgtacttac

SEQ ID NO: 442659 - DNA, 683 bp, Homo sapiens
  misc_feature: GZ8MTXP02H0E8S.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtatagcagcaacttagccctggtaccagcagaaacctggccaggctccaggctcctcatctatgctgcatccaccgagggccaacgtcggtaacctccgacgacgtacggtacaggtcgacgtaggggttcggtcgagggtacgtagtaccgttactacttccgacctaactacgacgagaccgacgtccgtgtacgtacgttaccgtaagtaagttttgtttaacgtaacttttaaacgttttattacgtttacgtaacgtaaggtacttaaagtttaaaattaaacgttaacgggttacgggttacgggtttaacccgggttaaccgaacggtaaaaccggggtaaaaccgtttaaagggaaaaacgtaaacgtaaaaccggtaaaaacgtaccggtttaggacggttaaccgtaacgaccgtaactacgtttccgttacgtttaccttaccg

SEQ ID NO: 442660 - DNA, 541 bp, Homo sapiens
  misc_feature: GZ8MTXP02JWD3V.2.7.A07.1.454.CMB.2.raw
  modified_base (500)..(500): a, c, t, g, unknown or other
  modified_base (519)..(519): a, c, t, g, unknown or other
  modified_base (523)..(523): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgcccaccctctcctgcagggccagtcagagtattagcagcaacttagcctggtaccagcaagaacctggaccaggctcccgaggcctcctcatctatgctgcatcccacgacgggccacgtggtaactccccgagcctagggttcaggtcggctagggtcggggtctgggggacaggtacgtttcatttcacaccatcagcacgcctagctagcttaggaattagtttgacttaaagtttattacgtgtcagctaagttataagtagtgggtgtacgtcggaccaaagggacctaaggganaaagtaccaaagacgttgnggcngaccacatcctagtctac

SEQ ID NO: 442661 - DNA, 641 bp, Homo sapiens
  misc_feature: GZ8MTXP02JVXUG.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccgaggcctcctcatctatgctgcactcccaccgagggccacgtcggtactccccagcccgtaggttcagtggcaggtggggtctgggggaccaggtcgttcagttctacacctatcgagcagccctgactagtcgtagtaagtattttagacttaaatttattactgtactaggtactaagttaattaaagtaacgttaggggttagtaaccgggtttaccgggaaccgtaaacgggggtaaacccgtaaaaggggtaaacgtaaaaacgttaaccggtaaaaaccggtaacggttacgggtacggtaaccgttacggaacccgtaaacccgtaacgtttccgtttaacggtttccgtttaacccg

SEQ ID NO: 442662 - DNA, 516 bp, Homo sapiens
  misc_feature: GZ8MTXP02FOBSL.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggctcctcatctatgctgcatcccaccagggccactggtatcccagccaggttcagtgcagtgggtctggggacagagttcattctcaccatcagcagccctgcagtctagaagtatttgactaatttattactgtcagtcagtataatacgtggtaggtacgttcggaccgaaagggaccaaagggttaacgaaatacgaaaacgtaacgtgtaggctagaccaccatctagtcttac

SEQ ID NO: 442663 - DNA, 763 bp, Homo sapiens
  misc_feature: GZ8MTXP02G1END.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcaagaacctggccaggcctccaggctcctcatctatgctgcactcccacgacgggccacgttcggtaactccccgaagtcccgtaacgggtttccgaaggttcgggaccgtaaggggttcgggggttacccttagggggggaaaccctaaggggttaaaccggttttaccctaaggtttttccccgtacccgaaacccctaaacgttcccgaaacgggcccctaaacgggtccccttacggaccgttaacgggttacccgttaaaggggtaaaacgtttattttttacggaaaccttttaaattttttaacttaaacgtttcgttaccgtaaagtaccttaaaggtttaaattaaaacgtttaacggtagggggttacgggtaacccggtttacgggaaccccggtaaaagggggaacccgtaaaaggggttaaacaaaacgtaccgtaaaacggtaaacgttggtaacggcgtacgaccgtaaactcgttacgtcgttacctttaacc

SEQ ID NO: 442664 - DNA, 568 bp, Homo sapiens
  misc_feature: GZ8MTXP02H853R.2.7.A07.1.454.CMB.2.raw
  modified_base (196)..(196): a, c, t, g, unknown or other
  modified_base (382)..(382): a, c, t, g, unknown or other
  modified_base (414)..(414): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaaanacgccaccctctcctgcagggccagtcagagtatagcagcaacttagcctggtaccagcagaaacctggccaggctcccaggcctcctcatcctatgctgcactcccaccgagggccatggtactccccgagcctaggttcaggtggctaggtcgggtctgggggacaggtacgtttccatttccncaccatcagcagcctgctagtctagaagtttntttagtatttaattttatacgtgtactagtactaagtaataagttacgtgggtaggtacgtacggaacgtaaacgggaactaaagggtaaacaaaacgtaacgaaaacgtacgttgacggtaactacgacctactactcgttacgttaccttcg

SEQ ID NO: 442665 - DNA, 587 bp, Homo sapiens
  misc_feature: GZ8MTXP02HSXB5.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgcccaccctctcctgcagggccagtcagagtatagcagcaacttagcctggtaccagcagaaacctggccaggcctcccaggcctcctcatctatgctgccatcccaccagggccagtggtactccccgagccaggttcaggtcggctaggttcggggtctgggggaactaggtagtttccaatttccacacccatcagcagcctgctagtctagtaagttatttcgacttaaattttattacgtgtacagactaagtaactaataacgttgggtacggtaccgttacgggacccgtaaaggggtacctaaagggtaaacaaaacgttaacgaaaacgtacgttaggaggtaacctaggacctacccgtattccttcgttacttaccg

SEQ ID NO: 442666 - DNA, 529 bp, Homo sapiens
  misc_feature: GZ8MTXP02JL500.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctgccaggctccaggctcctcatctatgctgcatcccaccagggccatggtactcccagccaggttcagtggcaggtgggtctgggggacaggtagttcatttcacaccatcagcagccctgcagtctagaagtatttgactaatttatactgtcagcagttataataacgtggtaggtacgttacgaccgtaaagggacccgaaagggtaacgaaaacgttacgaaaacgacgtagtaggcgtagacacctatccgtagtacttacc

SEQ ID NO: 442667 - DNA, 688 bp, Homo sapiens
  misc_feature: GZ8MTXP02H0SY2.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanacgccaccctctcctgcagggccagtcagagtatgcagcaacttagcctggtaccagcaagaacctggccaggcctcccaggcctcctcatctatcgctgacactccaccgagggccacgttggtacctccccgagtcctagggttccaggtcggacgtagggtcggggttccgtgggggaactaggtacgttcctaagtttccacctaaccctataccaacggccaacggtcccctagggacctacgggttacctaggtaaaacggtttattttacggtaactttaaagtttttactttaaccgttgttaccgtaaggtaccttaaggttaaactaaagtttaacggtgggttacgggtaaccgttaccggggaaccgtaaaacgggggtaacctaaaaggggttaacgtaaaacgtaccggtaaaacggtaacgttaggtacgggaacttacggaacctaccgtaattccgtttacgtttcctttacg

SEQ ID NO: 442668 - DNA, 588 bp, Homo sapiens
  misc_feature: GZ8MTXP02HEZ8D.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggtaccagcaagaacctggccaggcctccgaggcctcctcatctatcgctgcactcccaccgagggcccagtcggtaactccccgagcccgtaggttccaggtcggctagggttcgggtcgtgggggacaggtacgttcatttccacaccatcagcacgcctgctagtctagtaagttatttcgacttaattttatacgttgtactagactaagtataataacgtggtaggtacgttcggaaccgtaaacggggacgtaaaggtaacgaaaacgtaccgaaaacgtacgttaggtacggtaactacggaacctaacctatttccgtacgttactttaccg

SEQ ID NO: 442669 - DNA, 669 bp, Homo sapiens
  misc_feature: GZ8MTXP02IN7VL.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcagaaacctggccaggcctcccgaggcctcctcatctatgctgcactccaccgagggccctactggtactcccgagccctaggttccaggtcggcgtagggtcggggtctgggggaactaggtacgtttcctaatttcctacctaacccattaccgagcacggccctgcctagtctaggtaaagttattttagactttaaattttaacttacgttagtactaggtactaagtaaacttaaagttaacggttggggttaacggtaccggtttaccgggaaaccggtaaaacgggggtaaacccggtaaaaaggggttaaaccgaaaaacgtaaccggtaaaaaccggtaacgttaacgggtacggtaacgttacggaaccaacccgtaatttccgttacgtttcccctttaacg

SEQ ID NO: 442670 - DNA, 579 bp, Homo sapiens
  misc_feature: GZ8MTXP02G5QXL.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtatagcagcaacttgcctggtaccagcagaaacctggccaggctcccaggctctcatctatgctgcatccaccgagggccaacgtggtactccccagtccaggttcaggtgcaggtgggtctggggacaggtagttcattctacaccatcgagcagtcctagctagtctagaaagtttattacgtaatttaatttacttacgtagtacgtagtataaagttaattaaagttacggttgggtacggtacggtaccggaaccggtaaaacgggaacgtaaaaggtaaacgtaaaacgtaacgtaaaacgtacgtaggtacgaactacgactacgtacgttcgtacgttactac

SEQ ID NO: 442671 - DNA, 581 bp, Homo sapiens
  misc_feature: GZ8MTXP02H1SVG.2.7.A07.1.454.CMB.2.raw
  modified_base (198)..(198): a, c, t, g, unknown or other
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtatagcagcaacttagcctggtaccagcagaacctggccaggctccaggcctcctnatctatgctgcactcccacgagggccacgtcggactccccagtcctagggttcaggtcggacgtaggttcggggtctgggggactagggtacgtttcagttccacaccatcagccagccctgactagtctaggaattattttgacttaattttatacttgtacagtactaagtataagttacgtgggtcgtacggttcggaaccgtaaagggacctaaagggtaaactaaagtaacgtaaaacggtaacgttggtacggtcgtacggtaccaccttagtaccttcgttactttaccg

SEQ ID NO: 442672 - DNA, 617 bp, Homo sapiens
  misc_feature: GZ8MTXP02IJSHJ.2.7.A07.1.454.CMB.2.raw
  modified_base (196)..(196): a, c, t, g, unknown or other
  modified_base (383)..(383): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccacctctcctgcagggccagtcagagtattagcagcaacttagcctaggtaccagcagaaacctggccaggctcccaggctcctcatcatgctgcatcccaccgacgggccacgtcggtaactccccgagcctacggttcaggtcggctaggtggggtctgggggacaggtagtttcagtttcncaacccatcacgcacggtccctagtcacgttctagtaaagttattttgactttaaattttattacgttgtacctaaggactaagtaaattaaataacgtgggttcggtaaccgtttcgggaaccgaaaacggggtaaaccgtaaaagggtaaacgaaaaacgttactaaaaaccgggaaaacgttgtagggaaccttacggacctaaccgtagtcctttacggtcctttaaccg

SEQ ID NO: 442673 - DNA, 639 bp, Homo sapiens
  misc_feature: GZ8MTXP02H7EXO.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgccaccctctcctgcagggccagtcagagtatagcagcaacttagcctggtaccagacagaaacctggccagggcctcccgaggcctcctcatctatgctcgcactcccaccgacgggccctagtcggtactccccgagtcctacggttcaggtggcgtagggttggggttctgggggactaggtacgtttccagtttccctacaccctatcgagccacgccctgacctaggttctagaaagttattttgaactttaatttttatacgttgttacagtactaaagttaataagttacgtagggttacggtaaccggtttacgggaaccgtaaaacggggtaccgtaaaagggttaaacgaaaacgttaaaccgaaaaaccgtaacgttgggtacggtaacgtacggaacctaaccgtaagtctttcgtttaacctttccg

SEQ ID NO: 442674 - DNA, 517 bp, Homo sapiens
  misc_feature: GZ8MTXP02FJA8A.2.7.A07.1.454.CMB.2.raw
  modified_base (283)..(283): a, c, t, g, unknown or other
  modified_base (316)..(316): a, c, t, g, unknown or other
  modified_base (358)..(358): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccagctcctnatctatgctgcatccaccagggccactggtacnccagccaggttcagtgcagtggctggggacagagttcattcncacatcagcagcctgccagtctagaagtatttagacttaaatttaattactgttcagctaagtataaataagtggttaggacgttcggaccaaaaggggtaccaaaggtaacgaaaatacgaaaacgtaacgtgtaggaactgacacatctcgtcttac

SEQ ID NO: 442675 - DNA, 616 bp, Homo sapiens
  misc_feature: GZ8MTXP02JWM80.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccaggcctcctcatctatgctgcatcccaccgagggcccatggtactccccagcctaggtcagtggcaggtgggtctggggacaggtagttcattcacaccatcagcagcctgctagtctagtaacgtatttttacgactttaaattttacttacgttgttacaacggtactaagttaaattaaagttaaacgtggggttacggtaaccggtttaccgggaccgtaaaacgggggtaaacccgtaaaggggttaaacgtaaaaacgttaccgaaaaacggtaaccgttaggttacgggaaccttacgggaccctaaccgtatttaccgtacgttacctttaccg

SEQ ID NO: 442676 - DNA, 588 bp, Homo sapiens
  misc_feature: GZ8MTXP02H2DKD.2.7.A07.1.454.CMB.2.raw
  modified_base (196)..(196): a, c, t, g, unknown or other
  modified_base (281)..(281): a, c, t, g, unknown or other
  modified_base (369)..(369): a, c, t, g, unknown or other
  modified_base (395)..(395): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtatagcagcaacttagcctggtaccagcagaaacctggccaggcctccaggctccncatctatgctgcatccaccgagggcctatggactcccagccaggttcagtgcaggtgggtctggggacagtacgttcatttcacaccntcagcacgcctgcagtctagaagttntttgacttaaattttattactgttacagtactaagttaataaagttaacgtggttacggtacgtttaccgggacgtaaaacggggaacctaaaagggtaaacgtaaaaacgttaaccgaaaaaccgtacgttacggtacggtaaccgttacggaaccctaacccgtaatttcccttaacgtttacctttaccc

SEQ ID NO: 442677 - DNA, 634 bp, Homo sapiens
  misc_feature: GZ8MTXP02IKKHU.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccacctctcctgcagggccagtcagagtattagcagcaacttagcctggtaccagcaagaaacctggccaggcctcccgaggcctcctcatctatgctgccatcccgaccgaggggccctacgtcggtacctccccgaaggtcccgtaaggtttccaggtcgggactagggttcggggtctgggggaacaggtagtttccagtttccacacccatcagcacgcctgactagtctagtaagtatttgacttaattttacttacgttgtactaggtactaagttaaattaacgttaacggtggggttacggtaaccgggttacgggaacccggaaaacgggggtaaccgtaaaagggtaacgtaaaacgtaaccgaaaacggtaaaacgtggtacgggtaactacggaccctaactacttacgttacgttaccttacg

SEQ ID NO: 442678 - DNA, 529 bp, Homo sapiens
  misc_feature: GZ8MTXP02JD4NI.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccgagggccactggactcccagccaggttcagtggcaggtggtctggggacagtagttcagttctcaccatcagcagcctgcagtctagaatatttgactaaatttattactgtacagtacagtataatacgtgtaggtacgtcgacgtaagggacctaaggtaacgaaactacgaaaacgtaacgtggtacggaactaggacctaccgtatacgttcgtactttacg

SEQ ID NO: 442679 - DNA, 572 bp, Homo sapiens
  misc_feature: GZ8MTXP02GKZ2O.2.7.A07.1.454.CMB.2.raw
  modified_base (366)..(366): a, c, t, g, unknown or other
  modified_base (377)..(377): a, c, t, g, unknown or other
  modified_base (381)..(381): a, c, t, g, unknown or other
  modified_base (389)..(389): a, c, t, g, unknown or other
  modified_base (407)..(407): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaagacgcccaccctctccccgcagggccagtcagagtattagcagcaacttagcctggtaccagcagaaacctggccaggctcccaggcctcctcatctatgctgcactccaccgacgggcccactggtactcccagccctaggttcccaggtgcaggtgggtctggggcngagttcattcncacntcagccancctgctagtctagaagtntttagacttaaatttattactgttacagtctaagttaataagttacgtgggtacgtaccggttcggaccgtaaaagggtaccgtaaagggtaaagaaacgtaacgaaaacgtacgtaggtacgtacctaagaccctaaccgtattcctacggtctttacgtaccg

SEQ ID NO: 442680 - DNA, 585 bp, Homo sapiens
  misc_feature: GZ8MTXP02HD5N0.2.7.A07.1.454.CMB.2.raw
  modified_base (196)..(196): a, c, t, g, unknown or other
  modified_base (384)..(384): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatcccaccgacgggccctagtcggtaactccccgagccaggttccaggtggcctaggtggggtctgggggactaggtacgttcatttcncacccatccagccagccctgactacgtctaggtaaagtattttgaacttaaattttattacttgtacaggtactaagtaataagtacgtgggtacggtacggttacggaccgtaaaaggggaccaaagggttaaacgaaaacgtaccgaaaaacggtactacggtacgaacgtacggacacctatccttagtacctttacg

SEQ ID NO: 442681 - DNA, 604 bp, Homo sapiens
  misc_feature: GZ8MTXP02H7RJ4.2.7.A07.1.454.CMB.2.raw
  modified_base (195)..(195): a, c, t, g, unknown or other
  modified_base (423)..(423): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaanacgccaccctctcctgcagggccagtcagagtatagcagcaacttagcctggtaccagcagaaacctggaccaggctcccaggcctcctcatctatgctgcatccaccgagggcctacgtcggtactccccagtccgtaggttcaggtgcgtaggtcggggtctgggggactaggtacgttcatttcctacaccctatcagcacgcctgactagtctagtaaacgttnttttgaacttaattttattacttgtactagctaagtaattaaacgttacgtgggttacggtaacggttcgggaaccgtaaaggggtaaccctaaaagggttaaacgaaaacgttaaccgaaaacggttaacgttcggtaggtaaccttaggacctaacgtatccgttacgttcctttaccg

SEQ ID NO: 442682 - DNA, 538 bp, Homo sapiens
  misc_feature: GZ8MTXP02I5RZE.2.7.A07.1.454.CMB.2.raw
  modified_base (196)..(196): a, c, t, g, unknown or other
  modified_base (285)..(285): a, c, t, g, unknown or other
  modified_base (373)..(373): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcaagaacctggccaggctcccaggcctcctnatctatgctgcactccacgacgggcccagtcggtactcccagccaggttcagtggcgagtggggtctggggacaggtagttcatttcncacatcagcagtccctgactagtctagtaagtatttgacttaatttatacttgtacagtacaagttaataagtaacgttggtaggtacgttcgacgtaaggaccgaaagtaagaaataacgaaacgtaactggtagaactagactacctatctcgttacttaccg

SEQ ID NO: 442683 - DNA, 572 bp, Homo sapiens
  misc_feature: GZ8MTXP02JJKU6.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccaggcctcctcatctatgctgcatccaccgagggccacgtggtactcccagtccgaggttcagtcggcgaggtcggggtctgggggactaggacgtttcattctcaccatcagcagcctgcagtctagaagtatttagtactaatttatactgtacagactaagtaataagtacgtgggtacggtacgtacggacgtaaacggggaaccgtaaagggtaaacgaaagttaaaccgaaaacggtaaaccgtaggttacggaacgtacggacctaccgtactcgttacgttacttaacc

SEQ ID NO: 442684 - DNA, 615 bp, Homo sapiens
  misc_feature: GZ8MTXP02H6T4A.2.7.A07.1.454.CMB.2.raw
  modified_base (197)..(197): a, c, t, g, unknown or other
  modified_base (379)..(379): a, c, t, g, unknown or other
  modified_base (397)..(397): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggaccagcagaaacctggccaggcctcccaggcctcctcatctatgctgcactccaccagggccacgtggtactcccagccaggtcagtgcagtgggtctgggacagagttcattctcacatcagcacgcccngactagtctagtaagttntttacactttaaattttattacttgtactagtactaagttaaactaaagttaacggttcgggttacgggtaaccggttaccggaaaccggtaaaacggggtaaacccggtaaaagggtaaaacgtaaaacgtaaaccggtaaaaaccgtaacggttacggtaacgggtaacgtaacgtaaccgtaaccgtaacgtttccgttacgttttacccgtacg

SEQ ID NO: 442685 - DNA, 652 bp, Homo sapiens
  misc_feature: GZ8MTXP02HFTZB.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagactaacttagcctggtaccagacaagaaacctggccaggcctacccgaggcctcctcatctatcgctcgcactcccaaccgacggggccctaagttcggtacctccccgaagtccgtacggttccgaggttcggcgtagggttcggggtcgtgggggaacctaggggtaacgtttctaacgtttccaccgaaccctagtccgaacgtaccaacggtccctggacctagtcgttaaggtaagttattttacgactttaaattttagttaccgttagtactaagtactaagttaaataagttaacgtgggtacggtacgttacggaaccgtaaagggaaccgtaaaggtaaacgaaagttaacgaaaacgtacgtggtacggaacttacgacctaactacttacgttcgtacctttaccg

SEQ ID NO: 442686 - DNA, 502 bp, Homo sapiens
  misc_feature: GZ8MTXP02GMSRE.2.7.A07.1.454.CMB.2.raw
  modified_base (284)..(284): a, c, t, g, unknown or other
  modified_base (357)..(357): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccagctcctnatctatgctgcatccaccgagggccatgtatcccagccagtcagtgcagtggtctggggacagtattcattcncaccatcagcagcctgcagtctagaagtatttgactaatttatactgtcagcagtataataacgtggtgacgttcggaccgaaagggaccaaagggtaaacaaagtacaaaacgtactggtagctagactacattcgtcgtactc

SEQ ID NO: 442687 - DNA, 543 bp, Homo sapiens
  misc_feature: GZ8MTXP02J4MOD.2.7.A07.1.454.CMB.2.raw
  modified_base (197)..(197): a, c, t, g, unknown or other
  modified_base (377)..(377): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagtctggtaccagcagaaacctggccaggctcccaggctcctcatctatgctgcactccaccaggggccacttcggtatccccagccaggttcagtggctaggtggggtctggggacagtacgtttcatttccncacccatcagcagccctgcagtctagtaaagtattttgactaaattttattactgtcagcagtaataataacgtgggtgacggttacggaccgaaacgggaccaaaggtaaagaaaactacgaaaaccgtaacgtgtcggtccgtcgacacctactcttcttcttc

SEQ ID NO: 442688 - DNA, 554 bp, Homo sapiens
  misc_feature: GZ8MTXP02F39L0.2.7.A07.1.454.CMB.2.raw
  modified_base (319)..(319): a, c, t, g, unknown or other
  modified_base (359)..(359): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggcctcctcatctatgctgcatccaccagggccacgtgtacnccagccaggtcagtgcagtggctgggacagagttcattcncaccatcagcacgctgactagtctaagtagttatttagtacttaaatttatagtgtactagtataataattaacgtagttgggtacgtacgttacggaaccgaaacgggtaccgtaaaggtaaacgtaaactaaacgtaaaaccgtaacgtggtagaaccgtacgacctaaccgtagttctccgttactttaccg

SEQ ID NO: 442689 - DNA, 503 bp, Homo sapiens
  misc_feature: GZ8MTXP02FVPZP.2.7.A07.1.454.CMB.2.raw
  modified_base (354)..(354): a, c, t, g, unknown or other
  modified_base (459)..(459): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccaggggccactggtactcccagccaggttcagtggcagtgggtctggggacnggagttcattctcaccatcagcagcctgcagtgtgaagatttgactaatttatactgtcagcagtataatactggtgacgttcgaccaaagggaccaaagggtanaaagtacaaaacgtactggtaggctgacaccatctacgtcttac

SEQ ID NO: 442690 - DNA, 611 bp, Homo sapiens
  misc_feature: GZ8MTXP02JV8NA.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaacctggccaggctcccaggctcctcatctatgctgcatcccaccgaggggcccacgttggtactccccgagtcccaggttccaggtggcctaggtggggtctgggggaaccaggtacgtttcagtttcctacaaccctattccaagccacggccctagcctagtcgtagtaagttattttgacttaattttattacgttgtacgtagtactaaagttaattaaacttaacggttgggttacggtaaccgtttaccgggaaccgtaaacggggaaacccgtaaagggtaaacgtaaaacgtacgaaaacgaacgttggtacggaactacgactaccgtatcgtacgtacttccg

SEQ ID NO: 442691 - DNA, 523 bp, Homo sapiens
  misc_feature: GZ8MTXP02HD6YE.2.7.A07.1.454.CMB.2.raw
  modified_base (198)..(198): a, c, t, g, unknown or other
  modified_base (277)..(277): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaangccaccctctcctgcagggccagtcagagtatagcagcaacttgcctggtaccagcagaactgccagctccaggctctnatctatgctgcatccacacgggccacgtggtactcccagtccaggttcagtggctaggtgggtctggggacaggtagttcattcacaccatcagcagtcctgcagtctagaagtatttgacttaatttattacgtgtcagtcaagttataagtaacgtggtagtacgttacggaccgaagggtaccaaaggttaacgaaactacgaaaacgtacgtgtacgcgtagaccactagtctcgtacttac

SEQ ID NO: 442692 - DNA, 534 bp, Homo sapiens
  misc_feature: GZ8MTXP02GMEIO.2.7.A07.1.454.CMB.2.raw
  modified_base (361)..(361): a, c, t, g, unknown or other
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccatggtactcccagccaggtcagtgcagtgggtctggggacaggagttcattcncaccntcagcagcctgcagtctagaagtatttgacttaaatttattactgtcagctaagtataataacgtgggtagacgttcggacgtaaacgggacctaaaggtacgaaaactacgaaaacgtacgtaggtacggaacttacggacctaacctatccgttgttacctttacg

SEQ ID NO: 442693 - DNA, 588 bp, Homo sapiens
  misc_feature: GZ8MTXP02IGUMI.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggcctccaggcctcctcatctatgctgcatcccaccgagggcccacgtcggtactccccgagccctaaggttcaggtggactaggttcggggtctgggggactagggtacgtttccaatttccacacccatcagcagcctgcagtctagagtatttgacttaatttattacttgtacagtactaagttaataaagtacgtgggtaggtacgttacggaccgtaaacgggaaccgtaaagggtaaacgtaaaacgttaacgaaaacgtaaacgttggtacggtaacgtacgacctaccgtattaccttagttaccttacg

SEQ ID NO: 442694 - DNA, 524 bp, Homo sapiens
  misc_feature: GZ8MTXP02JEXQ4.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatccaccgagggccacgtggtactccccagccaggttcagtgcaggtgggtctggggacaggtagttcattctcaccatcagcagcctgcagtctgaagtatttgactaatttatactgtacagtcaagttataagtaactgggtagtacgttcggacctaaggggaccaaagggtaagaaaacgtacgaaaacgaactggtaggctagacacgattacgtcgttcttac

SEQ ID NO: 442695 - DNA, 624 bp, Homo sapiens
  misc_feature: GZ8MTXP02HGZ0A.2.7.A07.1.454.CMB.2.raw
  modified_base (198)..(198): a, c, t, g, unknown or other
  modified_base (430)..(430): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngccaccctctcctgcagggccagtcagagtatagcagcaacttagcctggtaccagcaagaaacctggccaggcctcccaggcctcctcatctatgctgacactcccaccgacgggccacgtcggtactccccgagccaggttcaggtggcagggttcggggtctgggggactaggtacgtttacactttcacaaccctatccagtcacgccctgctagtctagtaaagttnttttagacttaaattttatacgttgtacagtactaagttaagttaaataacggttgggtacggtaaccggtttacgggaaacccggtaaaaggggtaaacccgtaaaggggttaaacgaaaaacgttaccgaaaaaccgtaaacgttggttacggaaccctggaacctaccgtattccgttacgttctttaccg

SEQ ID NO: 442696 - DNA, 530 bp, Homo sapiens
  misc_feature: GZ8MTXP02FP4GS.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcgtcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggccatggtactccagccaggttcagtggcagtgggtctggggacaggagttcatttctcacctatcagcagccctgcagtctagaagtatttgacttaatttattactgtcagcaagtataataacgtggtgacgttcggaccgtaaagggaccaaagggtaacgaaaacgtacgaaaacgtaacgtaggttacggaactaggaccacctatcctacgtctttacc

SEQ ID NO: 442697 - DNA, 631 bp, Homo sapiens
  misc_feature: GZ8MTXP02JADE0.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcaagaacctggccaggcctcccaggcctcctcatctatgctgcactccaccgagggcccacgtcggtactccccgagcccgtaggttccaggtcggaccgtagggttcggggtctgggggaccagggtacgttacctaagtttcccgtaccaaaccctaacttccgaacgtcccgaacggtcccttaggaccctaggttctaagggtaaagttactttttacggtaaccttaaaatttttactaacgttgtactagtactaagtaacttaagtaacgtggtaggtacgtacggacctaaacggggaaccgtaaaggtacgaaaagtaccgtaaaacgtacgtggtacgcgtacgacaccgtatctacgtctttaccg

SEQ ID NO: 442698 - DNA, 526 bp, Homo sapiens
  misc_feature: GZ8MTXP02GNYA6.2.7.A07.1.454.CMB.2.raw
  modified_base (319)..(319): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttagcctggtaccagcaagaaacctggccaggcctcccaggcctcctcatctatgctgcatcccacagggccatggtacncccagccaggttcagtgcaggtggtctggggacagtagttccattcacaccatcagcagccctgcagtctagaagtatttgactaatttattactgtcagcaagtataataacgtggtagtacgttacggacctaaaggggaccaaagggtaacaaaagtacgaaaacgtaactggtaggctacgcctaacagtctacgttcttacg

SEQ ID NO: 442699 - DNA, 596 bp, Homo sapiens
  misc_feature: GZ8MTXP02GKM4E.2.7.A07.1.454.CMB.2.raw
  modified_base (377)..(377): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtattagcagcaacttagcctggtaccagacaagaaacctggccaggcctcccgaggcctcctcatctatgctgcatcccaccgagggccacgtggtactcccgagccaggttcagtggctaggtgggtctggggacaggtagttcagttcncacatcagcagcctgactagtctagaatatttcgacttaaatttacttactgtacagtactaagttaactaaagttacgttagggtaggtaccgtttacgggaaccgtaaaacggggtaaaccgtaaagggtaaacgtaaaagttaaccgaaaaccggtaacgttagggtacggtaaccgtacgaccgtaaccctagttaccgttcgttacctttaccg

SEQ ID NO: 442700 - DNA, 773 bp, Homo sapiens
  misc_feature: GZ8MTXP02FXTYX.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaggggaagacgccaccctctcctgcagggccagtcagagtatagcagcaacttagcctggtaccagacaacgaacctggccaggcctcccgaggcctcctcacttctatgctgccactcccaccgacgggccctacgttacggtacctccccgaggtacccgtaacgggtttccaggttcgggacgtaggggttcggggttacttcggggggaactaagggtacgtttacaacgttttcctaccgaacctactccgaacgtccgaacggtcccttacggacccgtaaggttaccgttaagggtaaacgtttaagttttttacggaaacctttttaaaagtttttaaacttttaaccgttaggtttaaccctaagggtaaccttaaaaggtttaaacttaaaagtttaaaccggttggggttaacgggtaaccgggtttaccggggaaacccgtaaaacgggggtaaaccgtaaaaggggttaaaacggtaaaaacgttaaaccgtaaaaaccggtaaaccgttgggttaacgggccgttaacggaacctaacccgtaacgtttccgttacggtttaccctttaacc

SEQ ID NO: 442701 - DNA, 585 bp, Homo sapiens
  misc_feature: GZ8MTXP02J5EZD.2.7.A07.1.454.CMB.2.raw
  modified_base (303)..(303): a, c, t, g, unknown or other
  modified_base (324)..(324): a, c, t, g, unknown or other
  modified_base (382)..(382): a, c, t, g, unknown or other
tcagacgctcgacacacgaccggtgctcgatttagcacgtgtcgcaggggtaggaactgctcagttaggacccagacggaaccatggaagccccagcgcagcttctcttcctcctgctactctggctcccagatgccactggagaagtggtgatgacgcagtctccagccaccctgtctgtgtctccgagggtaaagacgccaccctctcctgcagggccagtcagagtattagcagcaacttagcctggtaccagcagaaacctggccaggctccccaggctcctcatctatgctgcatccnccagggccactggtatccccngccacggttcgagtggcgaggtgggttcgtgggtacgagtacgttctactctcacccncacgagcgacgtccgcgtcgtagtcgtaggtaagtaggtttatctaactttaatttagtacctttgacgcgtagtaattaaatacgtaacggttaggtacgggtacggtacggtaccgtaacgggaccaaacggtaaaccggtaaacgtaaacgtaaacgaacgtaccgtaacggtcgtacgtccgtacctactactacgttc

SEQ ID NO: 442702 - DNA, 605 bp, Homo sapiens
  misc_feature: GZ8MTXP02HKZU8.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagcccaccctctcctgcagggccagtcagagtattagcagcaacttagcctggtaccagacagaaacctggaccaggcctcccaggcctcctcatctatcgctgacactcccaccgacgggcctacgtcggtaactccccgagcctagggttcaggtcggacgtaggtcggggtcgtgggggacaggtacgttcatttccacaccatcgagcagcctgctagtctagtaagttatttgactttaattttattacttgtcagtactaagtaattaaacgtaagttgggtacggttaccggttacgggacccgtaaaggggaaccgtaaaaggggttaacgaaaacttaacgaaaacgtaacgttggtacggcgttacggacctaaccgtactcgttacgttactttaccg

SEQ ID NO: 442703 - DNA, 567 bp, Homo sapiens
  misc_feature: GZ8MTXP02F9FZI.2.7.A07.1.454.CMB.2.raw
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccgaggctcctnatctatgctgcatccaccgagggccactggtactcccagccaggttcagtggcaggtgggtctggggacaggagttcattcacaccatcagcagccctgcagtctagtaagtatttcgacttaaatttattactgtactaggtactaagttaactaagttaacgtgggtaggtaacgtttcgggaacccgtaaacggggaaccaaaagggttaacgaaaactacgaaaacggtaacgtaggtacggaactacggaccaccgtagtcgttcgttacctttacc

SEQ ID NO: 442704 - DNA, 609 bp, Homo sapiens
  misc_feature: GZ8MTXP02GFQ8I.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtgttagcagcaacttagcctggtaccagcaagaacctggccaggcctcccgaggcctcctcatctatgctgcactccaccgagggccacgtggtactccccgagccagggttccaggtggctaggtcggggtcgtgggggacaggtacgttcattcacaccatcagcacgccctgccagtctagaagttatttagacttaaattttattactgtacagtactaagttaataaagttacgttggggtacgtaacggtttccgggaaccgtaaaaggggtaacccgtaaaaggggtaaacgaaaacgttaaccgaaaacggtaacgttagggttacggaaccttacggacctaacctacgttaccgttacgttacctttaaccg

SEQ ID NO: 442705 - DNA, 542 bp, Homo sapiens
  misc_feature: GZ8MTXP02GJV1X.2.7.A07.1.454.CMB.2.raw
  modified_base (358)..(358): a, c, t, g, unknown or other
  modified_base (376)..(376): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagcctggtaccagcagaaacctggaccaggcctcccaggcctcctcatctatgctgcatccacgagggcccacgtggactcccagccaggttcagtggacaggtcgggtctggggacnggtagttcattctcaccntcagcagcctgcgtatctaggaagttattttgactttaaattttattactgttacaggtactaagttataaatacgtggtgtacgttcggacgaaagggacaaaggtaacgaaagtacgaaaaccgtaagtggtacgctacgacctactagtctcgtactttaccg

SEQ ID NO: 442706 - DNA, 562 bp, Homo sapiens
  misc_feature: GZ8MTXP02GF3ZE.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaaacctggccaggcctcccaggctcctcatctatgctgcactcccaccgacgggccacgtcggtactccccgaagtcctaggttccagtggctaggtgggtctgggggacaggtagtttcatttcacaacctatcagcagcctgcagtctagaagttatttgacttaatttattactgtacagtctaagtaataatacgtggtaggtacgttacggaccgtaaagggaccgtaaagggtaacgaaaacgtacgaaaacgtaacgtagtacggaactacggacctacctatccgtcttcttac

SEQ ID NO: 442707 - DNA, 597 bp, Homo sapiens
  misc_feature: GZ8MTXP02FK3BH.2.7.A07.1.454.CMB.2.raw
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccaggcctcctnatctatgctgcatcccaccagggcccactggtactcccagccaggttcagtggcaggtgggtctggggacaggagttcatttcacaccatcgagcagcctgcagtctagtaagtattttgacttaaatttattactgtactagtactaagttaaattaaacgttaacgtagggttagggtaaccggtttacgggaacccgtaaaacgggggaaacccgtaaaaggggtaaacgaaaaacgttaaccgaaaaaccgtaacgtaggtacggaacgttacggacctaaccgtactttacttcgttactttacc

SEQ ID NO: 442708 - DNA, 608 bp, Homo sapiens
  misc_feature: GZ8MTXP02IPVM1.2.7.A07.1.454.CMB.2.raw
  modified_base (436)..(436): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaaacctggccaggcctcccaggcctcctcatctatcgctgccactcccaaccgagggccctacgtcggtaactccccgaggtccctagggttccaggtggacctaggtcggggtctgggggactaggtacgtttcagtttccacaccatcagcagcctgctagtctagaaagtttntttagtaactttaattttactacttgtacagtactaaagttaattaaagtacggtggtacggtaccggttacggaaccggtaaaacgggtaacgtaaaggtaaacaaaacgtaacgaaaacgtacgttggtacgtaacgtacgacctaccgtacttcgtacgtttacctacg

SEQ ID NO: 442709 - DNA, 516 bp, Homo sapiens
  misc_feature: GZ8MTXP02FHB4C.2.7.A07.1.454.CMB.2.raw
  modified_base (206)..(206): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctntcctgcagggccagtcagagtattagcagcaacttagcctggtaccagcagaaacctggccaggctcccaggctcctcatctatgctgcatccaccagggccactggtactcccagccaggttcagtgcaggtggtctgggacagagttcattctacaccatcagcagccctgcagtctgaagattttgactaatttatactgtcagcaagttataaataactggtaggtacgttcggacccaaaggggaccaaagggtaacgaaaatcgaaaacgaactggtaggctaggacaccatctcgtactttac

SEQ ID NO: 442710 - DNA, 723 bp, Homo sapiens
  misc_feature: GZ8MTXP02GXXOE.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggtaccagcagaaacctggccaggcctcccaggcctcctcatctatgctgcactcccaccgacgggcccacgtcggtactccccgacgtcctaacgggttccaggttgggccgtagggttcggggttacgttggggggacctaaggggtacggttttaccacttttccgtaccaacccgtaacttccgaaacggcaacggtcccgttagggaccctaagggttccgttaaggtaaacggttagtttttacggtaaacctttaaatttttaactttaaccgtttgttaccgtaaggtactaagttaaattaaacgttaacgttaggggttacggtaaccggtttacgggaacccggtaaaacggggtaaacccgtaaaggggtaaacgtaaaacgtaaccgtaaaaaccggtaacgttagggtacggtaacgttacggaccctaaccgtaactttaccgttcgttacctttaaccg

SEQ ID NO: 442711 - DNA, 530 bp, Homo sapiens
  misc_feature: GZ8MTXP02GW6LR.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggcctccgaggcctcctcatctatgctgcatccacgacggccacgtgtactcccagccaggttcagtgactaggtgggtctggggactaggacgttcattcacaccatcacgtcacgcctgctagtctagtaagtatttgacttaatttattacgtagtacagtacaagttaataatacgtggtaggtacgtacggacgaaggaccaaaggtacgaaatacgaaaacgacgtgacggctacgactacatcctgttacttac

SEQ ID NO: 442712 - DNA, 589 bp, Homo sapiens
  misc_feature: GZ8MTXP02IB81Y.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaanagccaccctctcctgcagggccagtcagagtattagcagcaacttagcctggtaccagcagaaacctggccaggctcccaggcctcctcatctatgctgcatccaccgagggccagtcggtactcccagcctaggttcagtggcgaggtgggtctgggggacaggtacgttcattctcacatcagcagccctgcagttctagtaagtatttgacttaattttatacttgtacagtactagttaattaagttaacgtgggtaggtacggtttaccgggaccgtaaaacgggggtaacccgtaaagggtaaacggtaaaactaaccgtaaaaccggtaacgttaggtacgggtcgtacggacctaccgtaacttccgtttacgttcctttaccg

SEQ ID NO: 442713 - DNA, 550 bp, Homo sapiens
  misc_feature: GZ8MTXP02IHR6N.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaagagccaccctctcctgcagggccagtcagagtattagcagcaacttagcctggtaccagcagaacctggccaggctcccaggctcctcatctatgctgcatcccaccagggccactggtaactccccagccctaggttcaggtggcaggtcggggtctgggggacaggtagttcagtttctcaccatcagcagcctgcctagtctagaagtatttgacttaaatttattactgtcagctaagtataaattacgtggtacggtacgttcggaccgtaaaacggggaccaaagggtaacgaaaacgttacgaaaacgtaactggtaggctggacctactactcttacgtctttacg

SEQ ID NO: 442714 - DNA, 696 bp, Homo sapiens
  misc_feature: GZ8MTXP02GHGCS.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaagacgccaccctctcctgcagggccagtcagagtattagcagcaacttagcctggtaccagacaagaaacctggccaggcctcccgaggcctcctcattctatcgctgccatccccgaaccgaggggcccaacgttcggtaacctccccgaaggccctaagggtttccaggtggacctagggttggggtaccgtgggggaacctaagggtacgtttccaagttttcccaccgtaaccctaattccgaagccgaacgcccttaggcctaaggttccttaaggtaaacgttacgtttttaggaaaccttttaaaatttttactttaaaccgttggttacctaagggtaccttaaagttaaattaaaacgttaacgtggggttacgggaaccgtttccggggaaacccgtaaaagggggaaccctaaaaggggttaaacaaaacgttaccgaaaacgtaacgtggtacggaactaggaccaacctatacgtcgttacttacc

SEQ ID NO: 442715 - DNA, 528 bp, Homo sapiens
  misc_feature: GZ8MTXP02GLAHR.2.7.A07.1.454.CMB.2.raw
  modified_base (396)..(396): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccaggcctcctcatctatgctgcatccacgagggccatggtactcccagccaggtcagtgcaggtgggtctggggacaggtagttcattctcaccatcagcacgcctgcagtctagtaagtntttgacttaatttattactgtcagtctaagttataaataacgtggtaggtacgttcggaccgtaaagggacctaaaggtacgaaaatacgaaaacgactggtaggctacgactaccgtatctacgtctttac

SEQ ID NO: 442716 - DNA, 656 bp, Homo sapiens
  misc_feature: GZ8MTXP02JXS4S.2.7.A07.1.454.CMB.2.raw
  modified_base (444)..(444): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggcctcctcatctatgctgcatcccaccagggtcccaacgtcggtaactccccgaagcccaagggttccaggtcggacctaggtggggtacgtgggggaacaggtagtttccagtttccctacaaccctactcgagtccaagccctggacctagttctaggtaaagttnttttacggaacctttaaattttacgtttaacctggtactaacggtactaaagttaaattaaattaaaccggttggggtacgggttaaccggtttccgggaaccgtaaaacgggggtaaccgtaaaagggttaaacgaaaacgttaacgaaaaacggtaacgttacggtagggaaccttaggacctaaccgtatacctttcggtcctttaccg

SEQ ID NO: 442717 - DNA, 711 bp, Homo sapiens
  misc_feature: GZ8MTXP02JPEPS.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggcctcccaggcctcctcatctatgctgcatcccaccgaggggcccacgtcggtaccctccgacgtccgtacggttcgaggtcggacgtagggttcgggtcggtcggggaactaggttaccgttactacgtttccacctactacgtacgaacgacgacgtcccgtcgactacggttacgtaaggtaacgtttagtttaccgtaaattttaaacgttttaactttacgttacgtaactacggtaacttaaagttaaaacgtttaaacgttaagggttacggggttaacggggttaacccgggttaacccgggaaaccgggtaaaaccggggtaaaccgttaaaaggggtaaaacgtaaaaccgttaaaccggaaaaacgttaccggttagggtaccgtaacgtacgaaccctacgttacttccgtttacgtttacctttaacccg

SEQ ID NO: 442718 - DNA, 543 bp, Homo sapiens
  misc_feature: GZ8MTXP02GPDE1.2.7.A07.1.454.CMB.2.raw
  modified_base (197)..(197): a, c, t, g, unknown or other
  modified_base (369)..(369): a, c, t, g, unknown or other
  modified_base (397)..(397): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggcctcccgaggcctcctcatctatgctgcactccaccgagggccacgtggtactcccagcctaggtcagtgcaggtggtctgggactgagttcattcncaccatcagcagctgcagtctagaagtntttcgacttaaatttacttactgtacagtactaagttaataagttaacgtgggtacgtacgttacggaaccgtaaaagggacctaaaagggtacgaaaactacgaaaacgtacgtggtacggctagaccactatctcgtacttacg

SEQ ID NO: 442719 - DNA, 503 bp, Homo sapiens
  misc_feature: GZ8MTXP02FTOM8.2.7.A07.1.454.CMB.2.raw
  modified_base (361)..(361): a, c, t, g, unknown or other
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctggggacagagttcattcncacatcagcagcctgcagtctgaagtatttgactaatttattactgtcagcagtataataactggtgacgttcggaccaaagggaccaaaggtaacgaaaagtacaaaacgtaactgtaggctgacaccatactgtacttac

SEQ ID NO: 442720 - DNA, 533 bp, Homo sapiens
  misc_feature: GZ8MTXP02FTTS9.2.7.A07.1.454.CMB.2.raw
  modified_base (483)..(483): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatcccaccagggccacgtggtactccccaagccctaggttcaggtggcaggtggggtctggggacaggtagttcatttcacaccatcagcagcctgcagtctagaagtatttgactaatttatactgtcagctaagtataaataacgtgggtacggacgttcgacgaaacggggtaccaaagggtanaaaatcgaaaacgtacgtggtacggctagactaccattctacgtctttac

SEQ ID NO: 442721 - DNA, 579 bp, Homo sapiens
  misc_feature: GZ8MTXP02I5JWM.2.7.A07.1.454.CMB.2.raw
  modified_base (195)..(195): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaanagccacctctcctgcagggccagtcagagtattagcagcaacttagcctggtaccagcagaaacctggccaggctcccaggctcctcatctatgctgcatccaccagggccactggtatccccagccaggttcagtggcagtgggtctggggacaggtagttcattctcaccatcagcacgctgactgtcgtagtaagttagtttgactttaatttacgttacttgtacgacgtactaagttaattaaagttaacgttagggtacggtacgttacgggacccgtaaaggggaaccgtaaagggtaaacgtaaaagttacgaaaacggtaacgtaggtacggtaaccgtcggactaacccgtattacgtacgtttacctttaccg

SEQ ID NO: 442722 - DNA, 536 bp, Homo sapiens
  misc_feature: GZ8MTXP02F1AKQ.2.7.A07.1.454.CMB.2.raw
  modified_base (320)..(320): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagagccaccctctcctgcagggccagtcagagtattagcagcaacttagcctggtaccagcagaaacctggccaggctcccaggctcctcatctatgctgcatccaccgagggccactggtacncccagccaggttcagtggcaggtgggtctggggacagtagttcattcacaccatcagcagcctgcagtctagaagtatttgacttaaatttatactgtcagctaagttaataaataacgtgggtaggtacgttcggaccgaaaagggaccaaaaggtaacgaaaatacgaaaaacgtaactggtaggaactcggacctaaccattctcgtctttac

SEQ ID NO: 442723 - DNA, 524 bp, Homo sapiens
  misc_feature: GZ8MTXP02FHG0C.2.7.A07.1.454.CMB.2.raw
  modified_base (367)..(367): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatccaccagggccacgtggtactcccagccaggttcagtggcaggtgggctggggacaggagttcatttcncaccatcagcagcctgcagtctagagtatttgactaatttattactgtcagctagtataataacgtggtggtacgttcggactaaggggacaaagggtaaagaaactacgaaaacgtaacgtggtacggaacgtacgacgaccatcgtacgtcttac

SEQ ID NO: 442724 - DNA, 533 bp, Homo sapiens
  misc_feature: GZ8MTXP02FN5JY.2.7.A07.1.454.CMB.2.raw
  modified_base (371)..(371): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggctcccaggcctcctcatctatgctgcatcccaccgagggccacgtggtactcccagccaggttcagtggctaggtgggtctggggacaggtagttcattcncaccatcagcagcctgcagtctagaagtactttgactaaatttatactgtacagtctaagttataactacgtgggtaggtacgttcggacgtaaaggggacctaaagggtaacgaaaatacgaaaacgtactggtaggctaggacacctatctacgtcttac

SEQ ID NO: 442725 - DNA, 572 bp, Homo sapiens
  misc_feature: GZ8MTXP02G5GXD.2.7.A07.1.454.CMB.2.raw
  modified_base (359)..(359): a, c, t, g, unknown or other
  modified_base (371)..(371): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatccaccgagggcccacgtcggtactccccgagccaggttcagtgcgaggtggtctggggacngtagttcattcncaccatcagcagcctgcagtctagaagtattttgacttaattttattacgttgtactagtactaagttaattaaagttacgtgggttaggtacggttcggaaccgtaaaacggggaaccgtaaagggtaacgaaaacgttacgaaaacgtaacgttaggtagccgttaggacctaactacttaccgttgttacctttaccg

SEQ ID NO: 442726 - DNA, 597 bp, Homo sapiens
  misc_feature: GZ8MTXP02GYZCJ.2.7.A07.1.454.CMB.2.raw
  modified_base (198)..(198): a, c, t, g, unknown or other
  modified_base (282)..(282): a, c, t, g, unknown or other
  modified_base (420)..(420): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngccaccctctcctgcagggccagtcagagtatagcagcaacttgcctggtaccagcaagaacctggccaggctccaggctcctnatctatgctgcatcccgaccagggccacgtcggtactccccagcctaggttcaggtcggctaggttcgggtcgtgggggacctaggtacgttcatttccgtaccactatcgaagtccacgcctgcagtctagtaagtnttttagacttaatttattctgtacgtatctaagtaataagttaacgtggttcggtaaccgttcggaaccggtaaacgggtacccgaaaagggttaacgaaaacgtacggtaaaaccgtaacgttaggtacggtaaccgtacgtaacctaaccgtactcgtttaacgttcctttaccg

SEQ ID NO: 442727 - DNA, 625 bp, Homo sapiens
  misc_feature: GZ8MTXP02G65I9.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagctaacttagcctggtaccagacaagaaaccgtggaccaggcctcccaggcctcctcatctatcgctgcactcccgaccgacgggcctacgtcggtaactccccgaggtccgaacgggtttccaggtcggccgtaggtcggggttctgggggacaggtacgtttccaatttccacaccctatccaagctacgccctgactacggtctagtaaagttattttgaacttaaattttacttacttgtactaggtactaagttaattaaagttaacgttgggtacgggtaaccgttacgggaaccgtaaaacgggggaacctaaagggtaaacgtaaaacgtacgaaaacgtaactggtacggctacgacgtacctattcctacgtactttacg

SEQ ID NO: 442728 - DNA, 667 bp, Homo sapiens
  misc_feature: GZ8MTXP02JGXM9.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanagccaccctctcctgcagggccagtcagagtattagcagcaacttagcctggtaccagcagaaacctgccaggcctcccgaggcctcctcatctatgctgcactcccaccgagggccctagtcggtaactccccgagtcccgaaggtttccaaggttcgacgtaggggttggggtcctgggggaacctagggtacgtttaccagtttccaccaaccctaatccgaacgcgaacggtcccttggactaggttactaggtaaagttatttttacggacctttaaagtttttattaccgtgttacctaaggtactaaaggttaacttaaacgttaacggttgggtacgggtaccgtttacggggaccgtaaaacgggggacctaaaagggttaaacgaaaacgttaccgaaaacgtaaccgttggacggtaactacggacctaaccgtagtttccgttaggttacctttaccg

SEQ ID NO: 442729 - DNA, 640 bp, Homo sapiens
  misc_feature: GZ8MTXP02IWA7I.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcgagggccagtcagtagtattagcagactaacgttagcctaggtaccagacaacgaaacctggaccacggcctcccgaggcctcctacatctatcgctgaccactccaccgacggggccaacgttcggtactccccgaggtacccgtagggtttccaggtcggcgtagggtcgggttcgtggggactagtacgttctattccacaccgtatcgacgcacggcctgactacgtactaagaacgttatttcgaactttaaattttacttaccttagtacctagtaacgtaaagttaattaagtaacgtggggttacgtaacggttcggaaaccggtaaagggaccggtaaaagtaacgtaaaacgtacgtaaaaccggtagttacggaacggtctaacggactaaccctatttccgttagtcctttacc

SEQ ID NO: 442730 - DNA, 714 bp, Homo sapiens
  misc_feature: GZ8MTXP02GNNBW.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccaccctctcctgcaggccagtcagagtattagcagcaacttagcctggtaccagcagaaacctggccaggcctcccgaggcctcctcatctatgctgcactcccaccgacgggccctacgttcggtaacctccccgacggtccctaacggggtttccagggttcgggaccgtagggttcggggttccgtgggggtaaccagggtacggttttccagttttcccaccaaccctattccaaggcccaacggtcccttaggaccctacggttcctaaggtaaagttagtttttacggtaccttaaagtttttaactttacgttagttacctaaggtacctaaaggttaaacttaaagttaaccgttagggggttacggttaaccggtttaccggggaaacccggtaaacgggggtaaacccgaaaagggttaaacggaaaaacgttaccgaaaaacggtaacgttacggtacggtcgttacggacctaacccgtattaccgttacggttacctttaccg

SEQ ID NO: 442731 - DNA, 662 bp, Homo sapiens
  misc_feature: GZ8MTXP02GC6R0.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagtagtatagcagctaacgttagcctacggtaccagacaacgaaccgtggaccacggcctacccgaggtcctcctcatctagtcgctgcactcccaccgacgggccctacgttcggtacctcccgacgtccgtacggttcgaggtcggacgtaggggttcgggtcgtggggacctagggtacgtttcctacgttcctaccgaccctataccgacggccacgtccgtcgactacgttactaaggtaattagttttacgaactttaaattttacgttacgttcgtactaaggtactaaagttaactaagttaaggtgggtacggtacggttaccggaacggtaaacggtaaaccgtaagggtaaacgtaaactaacggaaaacgtacgttacggtacggaacgttacggacctactagttaccttacgttcctttaaccg

SEQ ID NO: 442732 - DNA, 575 bp, Homo sapiens
  misc_feature: GZ8MTXP02JYGY7.2.7.A07.1.454.CMB.2.raw
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctaggtaccagcagaaacctggccaggctcccaggcctcctnatctatgctgcactcccaccgagggcccacgtggtactcccagcctaggtcaggtgcgtaggtggtctggggacaggtagttcatttcacgacctatcgagcacgtcctggactacggtctaggaacgttatttacgtacttaaattttattacttgttacagtactaagttaataaagttaacgttagggtacggtacgttacgacgaaacgggtaaccgaaaggtaacgaaaataccgaaaacgtaacgtggttacggcgtacgaccacgtattcgtactctttac

SEQ ID NO: 442733 - DNA, 579 bp, Homo sapiens
  misc_feature: GZ8MTXP02JY7KA.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatcccaccgagggccacgtcggtactccccaggcctacggttcagtggacaggtcggggtctgggggaacaggtacgttcattcctacacccatcagcacgccctgcagtctagaagttatttagacttaatttattactgtctagtactaagttaattaaataacgttgggtacggtaccggtttacggaccgtaaaacggggaaccctaaaggggtaaacgtaaaacgtacgaaaacgtaacgtaggtacggcgtacggaccacgtatccttacgtcttac

SEQ ID NO: 442734 - DNA, 539 bp, Homo sapiens
  misc_feature: GZ8MTXP02H3QA2.2.7.A07.1.454.CMB.2.raw
  modified_base (198)..(198): a, c, t, g, unknown or other
  modified_base (521)..(521): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaaangccaccctctcctgcagggccagtcagagtatagcagcaacttgcctggtaccagcagaacctggccaggctcccaggcctcctcatctatgctgcatcccaccgagggccacgtggtactccccgagtcctagggttccaggtcggactaggttcggggtctgggggactaggtcgtttaccatttccacaaccctatacagcacgccctgactagtctagaaagttattttgactttaaattttattacttgtacagtactaagtataagtacgtggtagtacgtcgacgaagggtacaaaggacaaatacaaacgactgngctgacacatctgtactc

SEQ ID NO: 442735 - DNA, 521 bp, Homo sapiens
  misc_feature: GZ8MTXP02FR00O.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggccacgtgtactccagccaggttcagtgcagtgggtctggggacaggagttcattctacacatcagcagcctgcagtctagaagtatttgacttaaatttattactgtacagcaagtataactaagtggtagtacgttcggacctaaagggaccaaaggtacgaaaatacgaaaacgtaactgtacggaactagaccaacctattacctgtactttc

SEQ ID NO: 442736 - DNA, 535 bp, Homo sapiens
  misc_feature: GZ8MTXP02FTF0Y.2.7.A07.1.454.CMB.2.raw
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaagagccaccctctcctgcagggccagtcagagtatagcagcaacttagcctggtaccagcagaaacctggccaggctccaggctcctnatctatgctgcatccaccgagggccacgtggtactcccagtccaggttcagtggctaggtgggtctggggacaggtagttcattcgacaccatcagcagcctgcagtctagaagtatttgacttaatttgttactgtacagtcaagtataatacgtggtagacgttacgacgtaaacgggactaaagggtacgaaaactacgaaaacgtaacgtggtacgaacgtagacctactagttctacgtactttac

SEQ ID NO: 442737 - DNA, 537 bp, Homo sapiens
  misc_feature: GZ8MTXP02JQ05O.2.7.A07.1.454.CMB.2.raw
  modified_base (366)..(366): a, c, t, g, unknown or other
  modified_base (396)..(396): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatccaccagggccactggtactcccagccaggttcagtggcaggtgggtctggggacaggagttcattcncaccatcagcagccctgcagtctagaagtntttgactaattttatactgtacagtctaagttaataactaagtggtaggtacgttcggacgtaaacggggaccaaagggtaacgaaaattacgaaaacgtacgtaggaggtctacggacacctatcctacgtcctttaccg

SEQ ID NO: 442738 - DNA, 618 bp, Homo sapiens
  misc_feature: GZ8MTXP02IKK4R.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtatagcagcaacttagcctggtaccagcaagaacctggccaggctcccaggctcctcatctatgctgccactccccaccgagggcccaacgtcggtaacctccccgaagcccgtaggttccaggtcggacgaggttcggggtcgtgggggactaggtacgtttcactttccactacccatcacgcacgccctagcacggttctaaggtaagtattttagactttaaagttttacttacgttgtactagactaagttaattaaagttaacgttgggtacggttaccggttcgggaaccggtaaaacgggtaaccgaaaagggtaacgtaaaacgtacgaaaacggtaaacgttgtacggcgtacgacgtacctatcgttacgttcctttac

SEQ ID NO: 442739 - DNA, 535 bp, Homo sapiens
  misc_feature: GZ8MTXP02IRGW2.2.7.A07.1.454.CMB.2.raw
  modified_base (340)..(340): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatccacagggccatggtactccagccagtcagtgcagtgggtcnggggacagtacgttcattcacaccatcagcagctgcagtctagaagtatttgacttaaatttatacttgtacagactaagtaattaaagttaacgtgggtacggtacggttacggacccgtaaagggaccgaaaggtaacgaaaatacgaaaacgaacgtaggtacggctagaccacctatactacgtctttacg

SEQ ID NO: 442740 - DNA, 836 bp, Homo sapiens
  misc_feature: GZ8MTXP02F2Q8D.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcgagggccagtcagagtattagcagacaacttacgccgtggtaccagacaagaacctggccacggcctcccgaggtcctcctcatctatcgctcgactacctcccgaacccgacggggacccctacggttacggtaacctcccccgaaaggtcccgtaacggggtttcgaacggttcgggaccgttaggggttcggggttaccgtaggggggaacctaaggggttacgtttacctacgtttttacccgacctaaccctaaacgttccgaacggtacccaacggtccccgttgggacccgtaacggtttaccgttaaaggggttaaagttttaacgtttttaccggtaaatttttaaaacgttttttaaactttaaacccggtttgttaacccgtaagggttaaccttaaaaggtttaaactttaaaacgtttaaaccgggtttgggggttaacggggttaaacccgggtttaccggggaaaacccgggtaaaacggggtaaccccggtaaaaaggggttaaaccgtaaaaacgttaaccggaaaaaaccgggttaacgttcgggtaaccgggtaaccttacggaaccctaacccggttatttccgttaacgtttcctttaacccg

SEQ ID NO: 442741 - DNA, 591 bp, Homo sapiens
  misc_feature: GZ8MTXP02H2DR2.2.7.A07.1.454.CMB.2.raw
  modified_base (406)..(406): a, c, t, g, unknown or other
  modified_base (411)..(411): a, c, t, g, unknown or other
  modified_base (436)..(436): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagccctggtaccagcaagaaacctggaccaggcctcccgaggcctcctacacttctatcgctgcactcccacgacgggcctacgtcggtaacctcccgaggtccctagggttccagttcgggacgtaggttggggtctgggggactaggtacgttctatttccnaaccntcagcaggcctgcagtctagaagtntttgacttaattttacttactgtaccagtactaagttaataaagtttaacggtgggttacggtacggtttaccggaacgtaaacggggtaacaaaaggttaagaaaattaaccgaaagaacgttgagctacgactacgtattcgtacgttactac

SEQ ID NO: 442742 - DNA, 493 bp, Homo sapiens
  misc_feature: GZ8MTXP02GJAEK.2.7.A07.1.454.CMB.2.raw
  modified_base (197)..(197): a, c, t, g, unknown or other
  modified_base (284)..(284): a, c, t, g, unknown or other
  modified_base (358)..(358): a, c, t, g, unknown or other
  modified_base (407)..(407): a, c, t, g, unknown or other
  modified_base (422)..(422): a, c, t, g, unknown or other
  modified_base (452)..(452): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaacctggccaggctcccaggctcctnatctatgctgcatccacagggccatgactccagccaggttcagtgcagtgggtctggggacagagttcatttcncaccatcgagcagccctgcagtctagaagtatttgacttaatttatacngtcagtcagtataanacgtggtgacgtgacaagggacaaggtaanaaatacaaacgacgtgagcgacgacactatcgtacgttctc

SEQ ID NO: 442743 - DNA, 570 bp, Homo sapiens
  misc_feature: GZ8MTXP02HC5PX.2.7.A07.1.454.CMB.2.raw
  modified_base (196)..(196): a, c, t, g, unknown or other
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttagcctggtaccagcagaaacctggccaggcctccaggctcctcatctatgctgcatccaccagggcccacgtggtactccccgagccctagggttccagtggacgtaggtcggggtctgggggactaggtagtttcatttcacaccatcgagcacgcctgctagtctagaacgttntttgacttaaattttactacgttgtacagtctaagtaataagtacgtggtacgtacgttacggaccgaaaaggggtaccaaaggtaacgaaaacttacgaaaacgtaacgtggtacggaactggaacctaccgtattccgttacgttcctttac

SEQ ID NO: 442744 - DNA, 528 bp, Homo sapiens
  misc_feature: GZ8MTXP02GK7RV.2.7.A07.1.454.CMB.2.raw
  modified_base (346)..(346): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggctcccaggctcctcatctatgctgcatccaccagggccactggtactcccagccaggttcagtgcaggtggtcnggggacaggagttcattctcaccatcagcagccctgcagtctagaagtatttgactaaattttattactgtcagtcaagttataaataacgtggtaggtacgtttcggaaccgtaaaggggaccaaaagggtaagaaaatacaaaaccggaactggtaggctacgcaccatctagtctttac

SEQ ID NO: 442745 - DNA, 553 bp, Homo sapiens
  misc_feature: GZ8MTXP02HELO5.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggcctcccgaggcctcctcatctatgctgcatccacgacgggccagtcggtactccccagcctagggttcaggtcggctaggtcggggtctgggggactaggtacgtttcatttccacaccatcagccagcctgctagtctagaagttatttgacttaattttatactgtcagtacaagtaataatacgtggtagtacgttcggaaccgtaaagggacctaaagggtaacaaaagtacgaaaacgtactaggacggtctaggacctacgtatcctcgtaccttac

SEQ ID NO: 442746 - DNA, 591 bp, Homo sapiens
  misc_feature: GZ8MTXP02HSMGX.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagngccaccctctcctgcagggccagtcagagtatagcagcaacttagcctaggtaccagcaagaacctggccaggcctcccaggcctcctcatctatcgctgcatcccacgacgggcctagtcggtactccccgagccctaggttcaggtggctaggtcgggtctgggggacaggtacgttccattccgtacaccatcgagtcacgtcctgctagtctaggtaagttacttttagactttaaattttacttaacttgtactagtactaagttaactaagtaacgttggtacggtacggttacggaacgtaaacggggaaccgtaaagggttaacgaaaacttacgaaaacgtaacgttggtacgaacctgaacctacgtattcctagtttcctacg

SEQ ID NO: 442747 - DNA, 574 bp, Homo sapiens
  misc_feature: GZ8MTXP02IOQFR.2.7.A07.1.454.CMB.2.raw
  modified_base (281)..(281): a, c, t, g, unknown or other
  modified_base (311)..(311): a, c, t, g, unknown or other
  modified_base (360)..(360): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccagctccagctcctnatctatgctgcatccacgaggccatgtacnccagccaggttcagtgctaggtcgggtctggggacagtacgttcattcnctacatcagcagcctgcagtctagaagtatttgacttaaattttactacttgtacagtacaagttaataaagttaacgtgggtacggtaacgttacgggaaccgtaaaacgggggtacctaaaagggtaaagaaaaacttaccgaaaaacggtaaaccgttggtaacggtaacgttacggaccaaaccctaagttcgtacgtttaccgtttacc

SEQ ID NO: 442748 - DNA, 651 bp, Homo sapiens
  misc_feature: GZ8MTXP02JZTH8.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggcctcccgaggcctcctcatctatcgctgcatcccaccgagggccagtggtactcccagccaggttcaggtcggactaggtggggtctgggggactaggtacgttcagttctacaccgatacgacgtcacgcccttgacgtacgtacgtaggtaaagttactttttagaacctttaaatttttaacttaaccgttgtaccgtaaggtacctaaagttaaacttaaacgttaaacggttggggttaccgggtaaccgggtttacgggaacccgtaaaacgggggtaaacccgtaaaaggggttaaacgaaaacgtaaccgtaaaaacggaaccgttaggtacggtctacggacctaccgtaattccgtacgttctttacccg

SEQ ID NO: 442749 - DNA, 546 bp, Homo sapiens
  misc_feature: GZ8MTXP02I8DLW.2.7.A07.1.454.CMB.2.raw
  modified_base (198)..(198): a, c, t, g, unknown or other
  modified_base (317)..(317): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctccgaggggaaanagccaccctctcctgcagggccagtcagagtattagcagcaacttagcctggtaccagcagaacctggccaggctcccaggctcctcatctatgctgcatccacagggccactggtacncccagccaggttcaggtggctaggtggggtctgggggacaggtagtttcagtttcacaccatcagcagcctgcagtctagaagtatttgacttaaatttattacgtgtacagtactagtaataagtaagtgggtggtaacgttcggacgtaaaacgggacctaaagggtaacgaaaatacgaaaacgtacgtagtaggaacctggacctaccattcgtacgttctttac

SEQ ID NO: 442750 - DNA, 514 bp, Homo sapiens
  misc_feature: GZ8MTXP02GC0RA.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatcccaccagggccacgtcggtactcccagccaggttcagtggcaggtggggtctgggggacaggtacgttcagttctcaccatcagcagcctgcagtctagaagtatttgacttaaatttatactgtacagtacagtataatacgtggtggtacgttcggacaacgggacaaggtacaaatacaaacgactgtacgctgacacatctacgtctttacc

SEQ ID NO: 442751 - DNA, 567 bp, Homo sapiens
  misc_feature: GZ8MTXP02J1WH1.2.7.A07.1.454.CMB.2.raw
  modified_base (378)..(378): a, c, t, g, unknown or other
  modified_base (412)..(412): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggcctccccgaggcctcctcatctatgctgccatccaccgagggccactggtactcccagcctaggttcagtggctaggtggggtctggggacaggtacgttcattcncaccatcagcacgccctgctagtctagtaacgtnttttgacttaaattttatactgtcagtactaagttataaatacgtgggtacggacgttacggacgtaaaacggggacctaaagggtaacgtaaaactaccgaaaacgtaccgttgggtaacgcgtacgaccaactagttctacggttcctttacg

SEQ ID NO: 442752 - DNA, 619 bp, Homo sapiens
  misc_feature: GZ8MTXP02HYY4I.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatccaaccgacgggccacgtggtactccccgagtccctaaggttcaggtcggcctaggttcggggtcgtgggggacctaggtacgtttcctaagtttcctacacccgtatccaagccagccctgccagtctagaagttatttgactttaaattttattacttgtactagtactaagtaattaataaacgttggttacggtacggtttaccgggacgtaaaacggggaccctaaaagggtaaacgtaaaacgtaaacgaaaaaccggtaacgttaggtacggaacgtacggaccaaccgtacgttacctttcgttacctttacg

SEQ ID NO: 442753 - DNA, 594 bp, Homo sapiens
  misc_feature: GZ8MTXP02FQG5Z.2.7.A07.1.454.CMB.2.raw
  modified_base (322)..(322): a, c, t, g, unknown or other
  modified_base (338)..(338): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcagaaacctggccaggctcccaggctcctcatctatgctgcatcccaccgagggcccagtggtacnccagccgaggttcagnggcaggttcggggtactggggactaggtacgtttcagttcctacaacctatccagcacgcccttgcagttcgagtaagtatttgacttaaatttattacgtgtacagtctaaagttaataagtacgttgggtagtaaccgttcggaacccgtaaaaggggaccctaaaaggggttaaacaaaaacgttacgaaaaacggtaacgtcggggttagaaccgttacgacctaaaccgtattcccgtgtttacctttacc

SEQ ID NO: 442754 - DNA, 599 bp, Homo sapiens
  misc_feature: GZ8MTXP02F6FRG.2.7.A07.1.454.CMB.2.raw
  modified_base (197)..(197): a, c, t, g, unknown or other
  modified_base (281)..(281): a, c, t, g, unknown or other
  modified_base (343)..(343): a, c, t, g, unknown or other
  modified_base (370)..(370): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaacctggccaggctccagctcctnatctatgctgcatccaccagggccacgtggtactccagccaggttcagtggcaggtgggtcnggggacaggtagttcattcctcacctntcagcagcctgctagtctagtaagtatttgacttaaatttattacttgtactagtactaagttaataagttaacgtgggttacggtacggttaccgggaccgtaaaacggggtaacccgtaaaggggttaaacgtaaaacgttaaccgaaaaccggtaaacgttcgggttacgggaaccgtttacggacccgtaaacctacgtttacctttacggttacccttttaccg

SEQ ID NO: 442755 - DNA, 674 bp, Homo sapiens
  misc_feature: GZ8MTXP02GBL30.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggaccaggcctcccgaggcctcctcatctatgctgccactcccaccgagggccctacgtcggtacctccccgaggtcccgtaggttccagggttcggacgtagggttcggggttcgtgggggaacctaggttaacgtttcctaacgtttcccacctaacccaattccgaacggccctaacggtcccttaggacctacggttcgtaaggttaaacgttagttttcgaaacctttaaagttttacttacgttgtactaaggtactaaaggttaaattaacgttaacggttaggggttacggtaaccggtttacgggaacccggtaaaacggggtaaacccgtaaagggtaaacgaaaacttacgaaaacgtacgtaggtacgcgtacgacctacgattcgtacttaccttacg

SEQ ID NO: 442756 - DNA, 749 bp, Homo sapiens
  misc_feature: GZ8MTXP02I6I8X.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaacctggccaggctcccgaggctcctcatctatgctgcatcccaccgacgggcccacgttcggtaactccccgagtcccgtaagggtttccaggtcggccgtagggttcggggtccttgggggaacctagggtagtttacccaagttttcccaccaaaccctataccgaacgtcccgaaacggtcccttagggacctaacgggttaccttaagggtaaagttacgttttttaggaaaccctttaaaagttttttactttaacgtttcggttacctaaagggtacctaaaaggtttaaacttaaaaggtttaaccggtttagggggttacgggttaacccggtttacgggggaacccgtaaaaacgggggtaaacccgtaaaaggggttaaacgtaaaaacgttaaccgtaaaaaccggtaaacgttagggttacgggaacttaaccggacctaaacccggttagttaccttacggtttacctttaacccg

SEQ ID NO: 442757 - DNA, 571 bp, Homo sapiens
  misc_feature: GZ8MTXP02H8XHS.2.7.A07.1.454.CMB.2.raw
  modified_base (283)..(283): a, c, t, g, unknown or other
  modified_base (357)..(357): a, c, t, g, unknown or other
  modified_base (425)..(425): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaagacgcccaccctctcctgcagggccagtcagagtattagcagcaacttgcctggaccagcagaacctgccagctccagcctcctnatctatgctgcactccaccgagggccagtcggactccccgagtccaaggttcaggtggacgtagggtcgggtcnggggaactaggtacgtttcaatttccaccaacccatccgaagcacgccctgactagtctagtaagttnttttagactttaaatttacttacgtgtacagtactaagtaataaagtacgtggtacgtacgtcggaacgtaagggaacaaagggtaaacaaagtaaccaaaacgtcgtagtacggctacgactacccgtatctacgtttactaccg

SEQ ID NO: 442758 - DNA, 574 bp, Homo sapiens
  misc_feature: GZ8MTXP02GSWSU.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccaccctctcctgcagggccagtcagagtattagcagcaacttagcctggtaccagcagaacctggccaggctccaggctcctcatctatgctgcatcccaccagggcccacgtggtactccccagccctaggttccagtcggcaggtggggtctgggggacaggtagttcattctcaccatcagcagcctgcagtctagaagtatttgacttaaatttattacttgtcagtctaagttataataacgttgggacggtacgtttacgggacccgtaaaaggggaccctaaaggggtaacgaaaacgttacgaaaaccggtacgttaggttacgggaacttacggacctaacctacgtccttacggttacctttaccg

SEQ ID NO: 442759 - DNA, 507 bp, Homo sapiens
  misc_feature: GZ8MTXP02F3K6E.2.7.A07.1.454.CMB.2.raw
  modified_base (318)..(318): a, c, t, g, unknown or other
  modified_base (362)..(362): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggctcccaggctcctcatctatgctgcatccacagggccacgtgtacnccagccaggttcagtgcagtggtctggggacagtagttcattcncaccatcagcagcctgcagtctagtaagtatttgactaaatttatactgtcagctaagtataagtacgtggtgacgttcggactaaacgggactaaaggtacgaaaatacgaaacgaactgtacggctagcaacatctgtcttac

SEQ ID NO: 442760 - DNA, 777 bp, Homo sapiens
  misc_feature: GZ8MTXP02GY0KM.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagagcccaccctctcctgcgagggccagtcagagtattagcagacaacttagcctaggtaccagcaagaaacctggaccaggcctcccgaggcctcctcatctatcgctgccactccccaaccgacgggcccacgttcggtaacctccccgaagtcccgtagggtttaccaagggttcggccgtaaggggttcggggtaccgtggggggaacctaagggtacgttttaccaacgtttcctaccaaaccctatacccgaaggcccaacgccccttaggaccctaagggtttcccttaaaggtaaacggtttatttttacggaaaccttttaaaagtttttaactttaaaccgtttggttaaccaaaaggttacctaaaaggtttaacttaaaaaggttaaaccggttgggggttaacggttaacccggggtttacccgggaaacccggtaaaaacgggggtaaaacccgtaaaagggggtttaaaacaaaaacgttaaaccggaaaaaccgtaaacgttggtaaccggaacgtaaccggaccctaaaacccgttagtttaccgtttacgtttacctttaccg

SEQ ID NO: 442761 - DNA, 589 bp, Homo sapiens
  misc_feature: GZ8MTXP02H5QIO.2.7.A07.1.454.CMB.2.raw
  modified_base (197)..(197): a, c, t, g, unknown or other
  modified_base (283)..(283): a, c, t, g, unknown or other
  modified_base (421)..(421): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaacctggccaggctccgaggctccncatctatgctgcatccaccgagggcctacgtggtactcccgagccaggttcagtggccgtaggtggggttcctgggggactaggtacgttcatttccacaaccatcagtccacgtccctgactagtctagaaagtttntttagacttaatttttactactgtacagtataagttaattaagttacgtgggttacggtacggttaccgggaaccgtaaaacggggtaactaaaagggtaaactaaaacgtaaacgaaaacgtacgttggacgtaacgtacgacctactacgttctacgtttactacg

SEQ ID NO: 442762 - DNA, 588 bp, Homo sapiens
  misc_feature: GZ8MTXP02HK55U.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtattagcagcaacttagcctggtaccagcaagaaacctggccaggcctccgaggcctcctcatctatcgctgccactcccaccgacgggcccacgtggtaactccccgagccctaagggtttccaggttcgggacgtagggttcggggtccgtgggggaactaaggtacgtttccaagtttccacacccatcacgcacgctgacagtctagtaagttatttgacttaattttatcgttgtcagtataagtataagttacgtggtggtacgttcggaacgtaaacggggacgtaaaggtaaacgaaagtaccaaaacggtacgtagtacggctagacctaccgtattcctagttacttac

SEQ ID NO: 442763 - DNA, 532 bp, Homo sapiens
  misc_feature: GZ8MTXP02JLJD3.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgccagggccagtcagagtattagcagcaacttagcctggtaccagcagaaacctggccaggctcccaggctcctcatctatgctgcatccaccagggcccatcggtactcccagtccaggttccagtggctaggtgggtctggggaccaggtagttcagttctcaccatcagcagcctgcagtcgtagtaagtatttgactaaatttattactagtcagtcagttataatacgtggtgacgttcggacgaaacgggaccgaaaggtaacgaaagtacgaaacgaacgttagaggtcctaggaccaccatcctgtactttacc

SEQ ID NO: 442764 - DNA, 526 bp, Homo sapiens
  misc_feature: GZ8MTXP02IKX3X.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaacctggccaggctcccaggctcctcatctatgctgcatcccaccgagggccactggtactccccagccaggttcagtgcagtgggctggggacaggagttcatttcgcaccatcagcagcctgcagtctgaagtattttgacttaaatttattactgttacagtactagtaataataacgtggtaggtacgttcggaccaaaggggaccaaaggtaacgaaaatacgaaaacgaaacgtgtaggctacgcaaccatctacgtctttac

SEQ ID NO: 442765 - DNA, 534 bp, Homo sapiens
  misc_feature: GZ8MTXP02FQVDX.2.7.A07.1.454.CMB.2.raw
  modified_base (284)..(284): a, c, t, g, unknown or other
  modified_base (360)..(360): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctnatctatgctgcatccacagggccactgtactccagccaggttcagtggcagtgggtctggggacagagttcattcncaccatcagcagcctgcagtctagaagtatttgacttaatttatactgtacagactaagtaattaataacgtgggtagtacggttacgggactaaacggggaacctaaagggttaacgaaaattacgaaaacggtaactggtaggaacctgacacctagtactcgttactttac

SEQ ID NO: 442766 - DNA, 518 bp, Homo sapiens
  misc_feature: GZ8MTXP02JNV1E.2.7.A07.1.454.CMB.2.raw
  modified_base (196)..(196): a, c, t, g, unknown or other
  modified_base (387)..(387): a, c, t, g, unknown or other
  modified_base (413)..(413): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccacagggccactgtatcccagccaggttcagtgcagtgggctggggacaggagttcattctcaccatcagcagccctgcagtctagaanattttgactaaatttattaactgtanagatagtataataagtagtaggtacgtacgacgaacggaacgaaggtaacgtaaagtaacgaaacgaacgtagtagtaacgtacgacactactacgtacgtactc

SEQ ID NO: 442767 - DNA, 531 bp, Homo sapiens
  misc_feature: GZ8MTXP02F0TTD.2.7.A07.1.454.CMB.2.raw
  modified_base (281)..(281): a, c, t, g, unknown or other
  modified_base (315)..(315): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctccaggctccncatctatgctgcatcccacagggccactggtacncccagccaggttcagtggcaggtcggggtctgggggacaggtagttccagtttcacaccatcagcagcctgcagtctagaagttatttgacttaaatttattactgtacagctaagtataataacgtggtagtacgttcggaccgtaaacggggaccaaaggtaagaaaactacgaaaacgtaactgtacggctagacaccgattctcgtctttac

SEQ ID NO: 442768 - DNA, 498 bp, Homo sapiens
  misc_feature: GZ8MTXP02HEZ4A.2.7.A07.1.454.CMB.2.raw
  modified_base (199)..(199): a, c, t, g, unknown or other
  modified_base (317)..(317): a, c, t, g, unknown or other
  modified_base (345)..(345): a, c, t, g, unknown or other
  modified_base (371)..(373): a, c, t, g, unknown or other
  modified_base (375)..(375): a, c, t, g, unknown or other
  modified_base (378)..(378): a, c, t, g, unknown or other
  modified_base (384)..(384): a, c, t, g, unknown or other
  modified_base (396)..(396): a, c, t, g, unknown or other
  modified_base (398)..(398): a, c, t, g, unknown or other
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanagccaccctctcctgcagggccagtcagagtatagcagcaacttagcctggtaccagcaagaaacctggccaggctccaggctctcatctatgctgcactccacgaggccatggtacnccagccagtcagtgcagtggctgggganagtagttcattcacacatcagcagcnnntntanatattntatattattatntnanataataataataagtagtagtacgtacgacgaacggaacgaaagtaaagaaataaacgaaacgaacgtagtagaacgtacgacactatactactactc

SEQ ID NO: 442769 - DNA, 732 bp, Homo sapiens
  misc_feature: GZ8MTXP02F8GKU.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggcctcccaggctcctcatctatgctgacactccaccgacgggccacgtggtacctcccgaggcctacggttcaggtggaccgtaggtcggggttccgtgggggacctagggtacgtttccaagtttccgtaccaaaccctattaccgaacggtaccaacggtccccgttaggaccctaacggttccgttaagggtaaaaggtttactttttacggtaaacctttaaaacgtttttacttaaccgttttaggttaaccctaaaggtacccgttaaaaggtttaaatttaaaacgtttaaccggtttagggggttacgggtaaccgggtttaccgggggaacccgtaaaacgggggtaaacccgtaaaaggggtaaacgtaaaaacggtaccgaaaaacggtaaccggttggtacggtaacgttacggaacctaacccgtaattccgttacggtttactttaccg

SEQ ID NO: 442770 - DNA, 545 bp, Homo sapiens
  misc_feature: GZ8MTXP02HMFNQ.2.7.A07.1.454.CMB.2.raw
  modified_base (196)..(196): a, c, t, g, unknown or other
  modified_base (283)..(283): a, c, t, g, unknown or other
  modified_base (403)..(403): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaacctggccaggctcccaggctcctnatctatgctgcatccaccagggccactggatcccagccaggtcagtggcaggtgggtctggggacagagttcattcacaccatcagcagcctgcagtctagaagtatttgactaaatttntacttgtcagctagtaactaataacgtggtagggtacgtttcgggacctaaaacggggaccaaagggtaaagaaaacgttacgaaaacgtaacgttaggacggaacgtaggacctacccaattcccgttgtttaccctttcg

SEQ ID NO: 442771 - DNA, 516 bp, Homo sapiens
  misc_feature: GZ8MTXP02HEPGF.2.7.A07.1.454.CMB.2.raw
  modified_base (196)..(196): a, c, t, g, unknown or other
  modified_base (362)..(362): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccacagggccactggatcccagccaggttcagtggcagtgggtctggggacaggagttcatttcncaccatcagcagcctgcagtctgaagtattttgactaaattttattactgtcagcagtataataactggtgacgttcggaccaaaggggaccaaaggtaagaaaatacgaaaacgtaactaggtaggaactaggacacccatctacgtctttac

SEQ ID NO: 442772 - DNA, 560 bp, Homo sapiens
  misc_feature: GZ8MTXP02G63A8.2.7.A07.1.454.CMB.2.raw
  modified_base (198)..(198): a, c, t, g, unknown or other
  modified_base (395)..(395): a, c, t, g, unknown or other
  modified_base (432)..(432): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaanagccaccctctcctgcagggccagtcagagtattagcagcaacttagcctggtaccagcagaaacctggccaggctccagctctcatctatgctgcatccacagggccatggactccagccaggttcagtggacagtcggggtctggggactaggtagttcatttcacaccatcagcagcctgctagtctagaagtntttgacttaatttactactgtacagactaagttaaanaattaacgtggtacggtacgttacggaaccgtaaaacggggaaccctaaaagggtaaagaaaacgttacgaaaaacgtacgtaggtacggaactacggaactaaccctattccgtcgttacttaaccg

SEQ ID NO: 442773 - DNA, 649 bp, Homo sapiens
  misc_feature: GZ8MTXP02IMGCB.2.7.A07.1.454.CMB.2.raw
  modified_base (198)..(198): a, c, t, g, unknown or other
  modified_base (386)..(386): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngccaccctctcctgcagggccagtcagagtattagcagcaacttagcctggtaccagcaagaaacctggccaggcctcccaggcctcctcatctatgctgcatcccaccgagggcccagtggtactccccagtcccagggttccaggtcggacaggttcggggtctgggggactagtcgttcatttcnctaccatcagcacgccctgctagtctagaaagttatttgaaacttaaatttttacgttaactttgtactaggtactaaagttaattaaaacgttaacgttggggttaacgggtaccggtttaccggggaaccgtaaaacgggggtaaacccgtaaaaggggttaaaacgtaaaaacgttaccggaaaaaaccggtacgttacgggtaaacggtccggttaacaacccgtaaccctagtttccgttacgtttcccgtttaaccg

SEQ ID NO: 442774 - DNA, 524 bp, Homo sapiens
  misc_feature: GZ8MTXP02GF7SI.2.7.A07.1.454.CMB.2.raw
  modified_base (283)..(283): a, c, t, g, unknown or other
  modified_base (420)..(420): a, c, t, g, unknown or other
  modified_base (438)..(438): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctccaggctcctnatctatgctgcatccaccagggccacgtggtactcccagccaggttcagtggctaggtgggtctggggacaggtagttcattctacaccatcagcagcctgcagtctagagtatttgactaatttatactgtacagntaagtataaatacgtggngtacgttcggacgaaagggaccaaagggtaacgaaaactacgaaaacgtactggtaggctagacctaccgtattcgtactctttac

SEQ ID NO: 442775 - DNA, 529 bp, Homo sapiens
  misc_feature: GZ8MTXP02H9K8E.2.7.A07.1.454.CMB.2.raw
  modified_base (194)..(194): a, c, t, g, unknown or other
  modified_base (299)..(299): a, c, t, g, unknown or other
  modified_base (387)..(387): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcaggggaanagccacctctcctgcagggccagtcagagtattagcagcaacttagcctggtaccagcagaaacctggccaggctcccaggctcctcatctatgctgcatccacngggccactggatccagccaggttcagtgctagtggtctggggacagacgttcattcgtcaccatcagcagcctgcagtctagaagttntttgacttaatttatactgtcagactagtataatacgtgggttacggacgttcgggaccgtaaaaggggaccgtaaagggtaacgaaaactacgaaaacgtaacgttggacggtctagaccacgtatcgtacgtaccttacg

SEQ ID NO: 442776 - DNA, 561 bp, Homo sapiens
  misc_feature: GZ8MTXP02HU1HK.2.7.A07.1.454.CMB.2.raw
  modified_base (377)..(377): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccaggcctcctcatctatgctgcatcccaccgagggccacgtggtactccccagccaggttcagtggctaggtcggggtctgggggacaggtagttcattcncacccatcagcagcctgcagtctagaagttcttttgacttaaattttattacgtgtacagtctaagtaataagtaacgtgggtacggtacgttacggaccgtaaaggggtaaccgaaaggtaaacgaaaattaccgaaaacgtacgtaggtacggctacgactacctagttcctacgttctacc

SEQ ID NO: 442777 - DNA, 537 bp, Homo sapiens
  misc_feature: GZ8MTXP02HQ8N8.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggcccacgtggtactcccagccaggttcagtgctaggtgggtctggggacagtagttcattctcaccatcagcacgcctgcagtctagtagtattttgacttaattttattacttgtactagtctaagttaataacttacgtgggtacggtacgttcggaccgtaaagggaccgaaaggtaacgaaatacgaaacgaacgtggtacggaactacgactacatctgttacttc

SEQ ID NO: 442778 - DNA, 530 bp, Homo sapiens
  misc_feature: GZ8MTXP02HWW21.2.7.A07.1.454.CMB.2.raw
  modified_base (197)..(197): a, c, t, g, unknown or other
  modified_base (379)..(379): a, c, t, g, unknown or other
  modified_base (482)..(482): a, c, t, g, unknown or other
  modified_base (501)..(501): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagcaacttagcctaggaccagcagaaacctggaccaggcctcccaggcctcctcatctatgctgcactcccaccgagggccctacgtggtactccccagccaggttcagtgctaggtgggctggggacagtgttcattcacacntcagtcacgcctgcagtctagtaagttatttgacttaatttattacttgtacagtctagtaataagtacgtggtagtacgtacgacgtaagggacaaggtaanaaatacaaacgtactaggngtaacgtcgacaccgtatcctagttctac

SEQ ID NO: 442779 - DNA, 607 bp, Homo sapiens
  misc_feature: GZ8MTXP02JRRYA.2.7.A07.1.454.CMB.2.raw
  modified_base (421)..(421): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatcccaccgacgggcccagtggtactcccgagccaggttcagtggctaggtcgggtcgtgggggacaggtacgtttcattccgtacaaccctatcaagcaggccctgactagtctagaaagtttntttacgtacttaatttattacttgtactagtactaagttaataaacgttaacggtcgggtacggtaccgggttaccggaaccggtaaaacggggtaaccgtaaagggtaaacgtaaaacgttaaccgaaaacggtacgtaggtacggaacgtacgacctacgtacttaccgttacgtttaccttcg

SEQ ID NO: 442780 - DNA, 596 bp, Homo sapiens
  misc_feature: GZ8MTXP02IW0II.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaaacctggaccaggcctcccgaggcctcctcatctatgctgcactccaccgagggcccacgtcggtactccccgagcccgtaggttcaggtggcgtaggtcggggtcgtgggggacaggtacgttctattcacacccatcagcacgtcctgcctagtctagtaacgttatttagactttaaattttacttacttggtacagtactaagttaactaagtaacgttgggtacggtacgttacggaaccggtaaacgggaccgtaaagggtaacgtaaaactacgaaaacgtaacgtggtaggaacgtacggacctaccgtattctacgtttaccttcg

SEQ ID NO: 442781 - DNA, 595 bp, Homo sapiens
  misc_feature: GZ8MTXP02GY45I.2.7.A07.1.454.CMB.2.raw
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatcgctgccatcccaccgacgggcccacgtcggtaactccccaggccagggttcagtcggctaggtggggtctgggggacaggtagttcagtttctacacctatcagcaggcctgcagtctagaagtntttgacttaattttatacttgtacagtacaagttataagtaacgtgggtaggtaccgtttcgggaccgtaaaacggggacctaaagggtaaacgaaaacgttaacgaaaaccggtaaacgttggttagggaaccttacggaccctaaaccgtattaccgttcggttacccttttaaccg

SEQ ID NO: 442782 - DNA, 571 bp, Homo sapiens
  misc_feature: GZ8MTXP02JXU16.2.7.A07.1.454.CMB.2.raw
  modified_base (355)..(355): a, c, t, g, unknown or other
  modified_base (375)..(375): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggtaccagcagaaacctggccaggcctcccaggcctcctcatctatgctgcatccaccgagggccacgtggtactccccagccaggttcaggtggctaggtgggtcnggggacaggtagttcattcncaccatcagcagccctgctagtctagaagtatttgacttaaattttctactgtacagtactaagttataaagtaacgtgggtacggtacgttcgggaaccgtaaaagggggaacctaaagggtaacgtaaaataccgaaaaacggtacgttggtacggcttacggaacctactagttccttacgttacctttaccg

SEQ ID NO: 442783 - DNA, 676 bp, Homo sapiens
  misc_feature: GZ8MTXP02G2TZP.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccgaggcctcctcatctatgctgcactccaccgacgggcctacgtcggtactcccgagcctagggttcagtggctaggttcggggtactgggggacaggtacgtttcgatttcaccaccgtacttaccacggtccaacgcccttagacgtacggttctaggtaaacgttagtttttcgaactttaaagtttttacgttacttacgtctaacgtacgttaaaggtttaacttaaagtttaaccggttaggggttagggtaacccggtttacggggaacccgtaaaacgggggtaacccgtaaaaggggtaaacgtaaaagttaacccggtaaaacggtaacgttcgggtacggtaaccttaacggacctaaccgtaactttccgttacgtttacctttaacg

SEQ ID NO: 442784 - DNA, 714 bp, Homo sapiens
  misc_feature: GZ8MTXP02IEDQF.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagagcccaccctctcctgcagggccagtcagagtatagcagcaacttagcctaggtaccagcaagaaacctggccaggcctcccgaggcctcctcactctatcgctgacactccaccgagggcctacgtcggtactcccagtccgtaacggttcaggtcggacgtagggttcggggtctgggggaactaggtacggtttccaacttttccacctaacccgattaccgaagccgacggtcccttaggcctaaggttcctaaagggtaaagtttacgttttacggtaacctttaaaattttttaacgtttacgtttacggttactaacggtacttaaagttaaattaaaagttaaccggtttaggggttaaccgggttaccgggtttaccgggaaacccggtaaaacgggggtaaacctaaaagggggttaaaacgtaaaacgtaaaccgtaaaaacggtacgttacggtacgggtaacttacggaccctaaccgtaatttccgtacgtttacttaaccg

SEQ ID NO: 442785 - DNA, 549 bp, Homo sapiens
  misc_feature: GZ8MTXP02G15O7.2.7.A07.1.454.CMB.2.raw
  modified_base (196)..(196): a, c, t, g, unknown or other
  modified_base (410)..(410): a, c, t, g, unknown or other
  modified_base (532)..(532): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaanagccaccctctcctgcagggccagtcagagtattagcagcaacttagcctggtaccagcagaacctggccaggctccagctcctcatctatgctgccatccaccagggccagtcggtactcccagcctaggttcaggtggcgtaggtcggggtctgggggactaggtagtttccatttcgcaacctatcgagcagccctgctagtctagaagtntttagactaattttattactgtcagactagtataaagtacgttggtggtaacgttcggacaacggggtaaccaagggttaacaaagtaactaaacgaacgtggacggtaactacgactaacntacttcgtactttaccg

SEQ ID NO: 442786 - DNA, 571 bp, Homo sapiens
  misc_feature: GZ8MTXP02FLHYD.2.7.A07.1.454.CMB.2.raw
  modified_base (264)..(264): a, c, t, g, unknown or other
  modified_base (369)..(369): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaaccnggccaggctcccaggcctcctcatctatgctgcatcccaccgagggccacgtggtactcccagccaggttcagtggcaggtgggctggggacagtagttcattcncacatcagcagcctgcagtctagtaatatttagacttaaatttattactgtacaggctaagttaataaattaacgtgggtacggtaccgtttcgggaaccgtaaaaggggaaacccaaagggttaaacgaaaacgttaccgaaaaacggtaacgtggttacgggaactacggacctaaccattacgttcgttactttaaccc

SEQ ID NO: 442787 - DNA, 574 bp, Homo sapiens
  misc_feature: GZ8MTXP02JE3HW.2.7.A07.1.454.CMB.2.raw
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtattagcagcaacttagcctggtaccagcaagaacctggccaggcctcccgaggcctcctcatctatcgctgcactccaccgacgggccacgtggtactccccagcctaggttcaggtcggcgtaggtggggtctgggggacaggtacgttcattctacaccatcagcacgcctgctagtctagaagttntttgacttaatttatactgtacagtactaagtaataagtacgtggtacggtacgttcgggaacgtaacggggaacctaaagggtaaacgtaaaacgtaacgaaaacgtaacgtggtacggaacgtacgacctacgtacttcgttacgttacctttacg

SEQ ID NO: 442788 - DNA, 531 bp, Homo sapiens
  misc_feature: GZ8MTXP02GO5LS.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccactggtactccccagccaggttcagtggcagtgggtctgggggacagtagttcattctcaccatcagcagcctgcagtctgaagtatttgactaatttattactgtacagctagtaattaataacgtggttacggtacgtttcggaccgtaaaggggaacccgaaagggtaaacgaaatacaaaacgaacgtaggtaggcgtagacaccatactcgtactttc

SEQ ID NO: 442789 - DNA, 597 bp, Homo sapiens
  misc_feature: GZ8MTXP02HHRVY.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgcccaccctctcctgcagggccagtcagagtattagcagactaacttagcctggtaccagcaagaaacctggccaggcctcccgaggcctcctcatctatcgctgcactccccgaaccgacgggcccagttcgggtaacctccccgaggtcctaacgggtttccaggtcgggcgtagggttcggggtccgtgggggaactaggtacgtttcaactttccgacaccctatcagtcacgctgctagtctagtaagttattttgacttaaattttatacttgtacagtactaagttaataagtaacgtggtacggtacggttacgacggtaaaacgggactaaagggtaaacaaagtacgaaaacgtacgtagtacgcgtacgactacgtatctcgtactcg

SEQ ID NO: 442790 - DNA, 655 bp, Homo sapiens
  misc_feature: GZ8MTXP02I1BAQ.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagcccaccctctcctgcagggccagtcagagtattagcagcaacttagcctggtaccagcagaacctggccaggctccaggctcctcatctatgctgcactcccaccgagggcccaacttcggtaactccccgaaggtccctaagggtttcaggttcggacgtagggttcggggtcgtgggggacctaggtacggtttccaatttccgaccaacccgtataccagaccgacgcccgttagccgtaggttcctaggtaaagttagttttagaacttaaattttattacgttgtaccaaggtactaaagttaattaaacgttaacggtgggttacgtaaccggtttacggacccggtaaaagggggaacccaaaaggggttaaacgaaaacgttacgaaaacggtaacgttacggtacgggcctaacggacccaaccgtatcccgttagttaccctttacc

SEQ ID NO: 442791 - DNA, 576 bp, Homo sapiens
  misc_feature: GZ8MTXP02GGZYU.2.7.A07.1.454.CMB.2.raw
  modified_base (196)..(196): a, c, t, g, unknown or other
  modified_base (403)..(403): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcaagaaacctggaccaggcctccccgaggcctcctcatctatgctgcatccaccgagggccagtggtactcccgagccaggttcagtggctaggtgggtctggggacagtagttcatttcacaccatcagcagctgcagtcagtaagtntttgacttaaatttactacgtgtacagtctaagttattaaataacgtgggtacggtaaccgtttccgggaacgtaaaacggggtaccctaaaaggggttaaacgaaaacttacgaaaaaccggtaactgggtaggaaccttacggacctaacctattcgtcgttactttaccg

SEQ ID NO: 442792 - DNA, 553 bp, Homo sapiens
  misc_feature: GZ8MTXP02GBKAR.2.7.A07.1.454.CMB.2.raw
  modified_base (371)..(371): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctgccaggctcccaggctcctcatctatgactgcatccacgacgggccacgtcggtactccgagtccacggttcagtggcaggtgggtctggggacagtagttcattcncaccatcagcacgcctgacagtctagtaagtactttgactaaatttatactgtacagtctaagttaataagtaacgttgggtacggtaacgtttcgggaaccgaaaacggggaacctaaaagggtaacaaaagttaccgaaaacgtaacgtgtaggctagactaccatacgtgtacctttac

SEQ ID NO: 442793 - DNA, 592 bp, Homo sapiens
  misc_feature: GZ8MTXP02JQPCH.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtattagcagcaacttgcctggtacagcagaacctggccaggcctcccaggctcctcatctatgctgcactcccaccgacgggccacgtggtactccccagccacggttcagtggcaggtcgggtctggggacagtacgttccagtttcctcaccgtatccgaggcacgtccctagtacctacggttcctaggtaacgtttattttacgaactttaaattttactttaacgttagttaccagtactaagttaactaagttaacgtgggtacggtacgttacggaaccgtaaacgggacgaaagggtaagaaactacgaaaaccgtagtaggtaggaactcggacaccgtagtaccttactacttacg

SEQ ID NO: 442794 - DNA, 562 bp, Homo sapiens
  misc_feature: GZ8MTXP02IRCI2.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtattagcagcaacttgcctggtaccagcagaacctggccaggctcccaggcctcctcatctatgctgcatcccaccagggccactcggtactccccgagcctacggttccaggtggactaggtcggggtctgggggacaggtagttccattctcaccatcagcagcctgcagttctagtaagttatttgacttaaattttattacttgtacagactagttataatacgtgggtaggtacgttcggaccgtaaaggggacctaaagggtaacgtaaaagtacgaaaacgtaacgttaggtacggaacttcgactaacctgtacgttcgttactttac

SEQ ID NO: 442795 - DNA, 561 bp, Homo sapiens
  misc_feature: GZ8MTXP02GB5W8.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcaagaaacctggccaggctcccaggcctcctcatctatgctgccactcccaccgagggccacgtggtactccccagccaggttccagtcggctaggtgggtctgggggacaggtacgttcattcgacacccatcagcagcctgacagtctagaagttgtttagacttaaatttattactgttacagtactagtaattaataacgttgggtacggtaccgttcggaccgaaagggtaccaaagggttaacaaaacgtacaaaacgtaacgtcgtaggaacctggacctactatctcgttactttcc

SEQ ID NO: 442796 - DNA, 583 bp, Homo sapiens
  misc_feature: GZ8MTXP02JSPK7.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcgagggccagtcagagtatagcagcaacttgcctggtaccagcaagaacctgccaggcctccaggcctcctcatctatgctgccatcccgacgacgggccaacgtcggtacctcccaggtccaaggttcaggtcggctagggtcggggtctgggggaacaggtacgttcagtttccacacccgatccgaagtcagtccctagtccagttctaggtaatagttttacgaacttaattttagtactgtacagtataagtataagtacgtggtacgtacggtacgacgaaagggtaccaaaggtaaacgtaaactacgaaaaccgtagtaggtacgaattacggacaaccgttatacgttacgtacctacg

SEQ ID NO: 442797 - DNA, 551 bp, Homo sapiens
  misc_feature: GZ8MTXP02I9625.2.7.A07.1.454.CMB.2.raw
  modified_base (401)..(401): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggcccacgtggtactccccagccaggttcagtggcaggtgggtctgggggacaggtagttcattctcaccatcagcagcctgcctagtctagaagtntttgactaattttatacttgtcagtacagttataataacgtggtacgacggtttacggaccgtaaaggggacccgaaagggtaagaaaacgttacgaaaacgtaaactggtacgggaacctggacctaccgtatcgttacgtttcttacc

SEQ ID NO: 442798 - DNA, 512 bp, Homo sapiens
  misc_feature: GZ8MTXP02H33EN.2.7.A07.1.454.CMB.2.raw
  modified_base (365)..(365): a, c, t, g, unknown or other
  modified_base (393)..(393): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggctcctcatctatgctgcatccaccagggccactggtactcccagccaggttcagtgcagtgggtctggggacaggagttcatttcncaccatcagcagcctgcagtctgaagtntttgacttaaatttattactgttacagtcaagtataatacgtggtgtacgttcgacgaaagggaccaaaggtacgaaaactcaaaacgtactgtagctagacacctatcctagtcttac

SEQ ID NO: 442799 - DNA, 606 bp, Homo sapiens
  misc_feature: GZ8MTXP02HJY1T.2.7.A07.1.454.CMB.2.raw
  modified_base (573)..(573): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagccctaggtaccaggcaagaaacctggccaggcctcccgaggcctcctcatctatgctgcactccaccgacgggccacgtggtaactccccagtccaggttccagtggctaggtgggtcgtgggggactaggtacgttctattcctactacccaatcgacgccagcccgttgctagtctagtaaagttattttcgacttaaattttattacgttgttacacgtactaagtaaattaaagtaacgttgggtacggtacggttacggaaccgtaaaggggacctaaaagggttaaccgaaaattacgaaaacgtacgttacggtacggaacgtnaccgtaacctgttccgttactttacttttaccg

SEQ ID NO: 442800 - DNA, 554 bp, Homo sapiens
  misc_feature: GZ8MTXP02I19CP.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccagcctcctcatctatgctgcatccacagggccactggtactcccagccagttcagtggcaggtggtctggggacaggagttcattcacaccatcagcagcctgctagtctagaagttatttgacttaaattttattacttgtacagtactaagtaataagttaacgtggtacggtacggttcggaccgtaaaaggggaccctaaagggttaacgaaaacgttacgaaaacgtaacgtggtacggaactacggactaacctacttacgtacgttacttacg

SEQ ID NO: 442801 - DNA, 556 bp, Homo sapiens
  misc_feature: GZ8MTXP02JZI5Y.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccgaggcctcctcatctatgctgcatcccaccgagggccacgtggtactccccagcctaggttcagtggctaggtggggtctggggacaggtacgttcattccacacatccagcagccctgctagtctagaagtatttgacttaagtttattacgtgtacagtactagttataaatacgtggtaggtaccgttcggaccgaaacgggtaccgaaagggtaacgaaaacgttacgaaaacgtacgtggtacgcgtacgaccacctatccgttcgtactttacg

SEQ ID NO: 442802 - DNA, 575 bp, Homo sapiens
  misc_feature: GZ8MTXP02HWZPV.2.7.A07.1.454.CMB.2.raw
  modified_base (197)..(197): a, c, t, g, unknown or other
  modified_base (340)..(340): a, c, t, g, unknown or other
  modified_base (390)..(390): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaaacctggccaggctccaggcctcctcatctatgctgcatccacagggccactggatcccagccaggtcagtgcagtggtcnggggacagagttcattcacaccatcagcacgcctgcagtctagaaagttntttagacttaatttattacttgtactagactaagttaaataaattaacgttgggtacggtaaccggttaccgggaacgtaaaacggggtaaaccgtaaaagggtaaacgaaaacgtaaaccgaaaacgtaacgttagggtacggtaaccgtacgacctaacctacgttccgttacgttaccttac

SEQ ID NO: 442803 - DNA, 679 bp, Homo sapiens
  misc_feature: GZ8MTXP02IA74H.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaancgccaccctctcctgcgagggccagtcagagtatagcagacaacttagcctggtaccagcaagaaacctggccaggcctcccgaggcctcctcattctatcgctgcactcccaaccgacgggccctacgtcggtacctccccgagccgtaaggtttccaggtcggacgtagggttcggggtcgtggggaactaggtacgtttacctaagtttccacaacccgtatccgaacgcgtacgcccgtgtaccgtagttactaaggtaaagtttacttttagaacttttaaatttttacgttacgttagtacctagtacttaagttaaattaaagttaacggttgggttacgggtaccggttaaccgggaaccgtaaaacggggtaaccgtaaaggggtaaaactaaaacggttaaccgaaaaacgtacgttacgtacggaaccgttacgaacctaccgtacgtttccgttacctttacctttaccg

SEQ ID NO: 442804 - DNA, 559 bp, Homo sapiens
  misc_feature: GZ8MTXP02IWFA7.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggctcccaggctcctcatctatgctgcatccaccacgggccacgtcggtactccccgagcctaggttcaggtcggctaggtcggggtctgggggaccaggtacgttctattcgtaccaccatcgagcacggccctgactacgtcgtagtaaagtagtttcgacttaaattttatacttgtacagactagtataatacgtggtagtacgttacgacgtaacgggaccgaaagggtactaaacgtactaaaacgtacgtaggtagaacgtagaccactatacttcgtacttac

SEQ ID NO: 442805 - DNA, 551 bp, Homo sapiens
  misc_feature: GZ8MTXP02GUYTJ.2.7.A07.1.454.CMB.2.raw
  modified_base (345)..(345): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgccaccctctcctgcagggccagtcagagtatagcagcaacttagcctggtaccagcaagaaacctggccaggcctcccaggcctcctcatctatgctgcatcccacgagggccagtgactccagccagtcagtgcaggtggtcngggacagtgttcattcacacatcagcagcctgcagtctagaagttatttgacttaaatttattacgtgttacagtactaagtattaaagtaacgtgggtacggtaaccgttcggaaccgtaaaaggggaccctaaaagggtacgaaaagtaccgaaaacgtaacgtggtaacggcttacggactaaccgtatccgtagtctttacc

SEQ ID NO: 442806 - DNA, 528 bp, Homo sapiens
  misc_feature: GZ8MTXP02JW4CL.2.7.A07.1.454.CMB.2.raw
  modified_base (366)..(366): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagcctggtaccagcagaaacctggccaggctcccaggcctcctcatctatgctgcatccaccagggccatggtactcccagccaggttcaggtgcaggtgggtctggggacaggtagttcagttcncaccatcagcacgcctgcagtctaggtaagtatttgaacttatttaattactagtcagactaagtaataactaagtggtagtacgttcggacgaacgggtacaaaggtacgaaaatacaaaacgaacgtgtacggctacgaccaacttatcttacgtcttac

SEQ ID NO: 442807 - DNA, 646 bp, Homo sapiens
  misc_feature: GZ8MTXP02FMIXE.2.7.A07.1.454.CMB.2.raw
  modified_base (197)..(197): a, c, t, g, unknown or other
  modified_base (286)..(286): a, c, t, g, unknown or other
  modified_base (449)..(449): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccaggcaagaacctggccaggcctccgaggcctcctnactctatgctgccactcccgaacgacgggtcccagttcggtacctccccgagtcccgtaggtttccgaggtcggacgtaggggttcggggtacgtgggggaactaagggttacgttactactttccacctacccatcgacggcacggtccctgacgacggttntaaggtaagtttagttttacgaacttttaaatttactaacgttgtacaagttataagttaaattaaacgttacgggttagggtaccggttaaccggttacggggaaaccgtaaaaggggaaaccgtaaaagggtaaacgaaaactaccggaaaaacgtcgttgtacgaacgtcgaaccttacagttctcgttactac

SEQ ID NO: 442808 - DNA, 559 bp, Homo sapiens
  misc_feature: GZ8MTXP02FRNSI.2.7.A07.1.454.CMB.2.raw
  modified_base (366)..(366): a, c, t, g, unknown or other
  modified_base (398)..(398): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctcccaggctcctcatctatgctgcatcccaccagggccacgtggtactcccagccaggttcagtggcagtgggtctggggacagagttcattcncaccctatcagcacgcctgcagtctagaagtntttgactaaatttattactgtcagctaagtataaatacgtggtggaacgttcggacctaaaggggaaccctaaagggtaacgaaaactacgtaaaaacggtaacgtacggttaacgggcttaacgacctaacccgtattaccgtacgtttacctttaaccg

SEQ ID NO: 442809 - DNA, 505 bp, Homo sapiens
  misc_feature: GZ8MTXP02HP0AU.2.7.A07.1.454.CMB.2.raw
  modified_base (283)..(283): a, c, t, g, unknown or other
  modified_base (359)..(359): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacccctgtctgtgtctccagggggaaagagccaccctctcctgcagggccagtcagagtattagcagcaacttagcctggtaccagcaagaactggcaggctccaggctcctnatctatgctgcatccaccagggccatggtatcccagccaggttcagtgcaggtggtctggggacagagttcattcnaccatcagcagcctgcagtctagaagtatttgacttaatttattactgtcagtcagtataataactggtagacgttaggactaaacgggaccgaaaggtaacgaaaatacgaaaacgaactgtgaactgactacatctagtcttac

SEQ ID NO: 442810 - DNA, 517 bp, Homo sapiens
  misc_feature: GZ8MTXP02H84AW.2.7.A07.1.454.CMB.2.raw
  modified_base (197)..(197): a, c, t, g, unknown or other
  modified_base (347)..(347): a, c, t, g, unknown or other
  modified_base (411)..(411): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaaacctggccaggctcccaggctcctcatctatgctgcatccaccagggccagtgactccagcagtcagtgcagtgggtctgggacagngttcattcacaccatcagcagcctgcagtctagaagtattttgactaatttattactgtacagntaagtataataatggtagacgttcgggacctaaagggaacctagggtaaaacgaaagtaacgaaaacgtacgtaggcgtaacgtcgaccactatactcgttactac

SEQ ID NO: 442811 - DNA, 559 bp, Homo sapiens
  misc_feature: GZ8MTXP02HNGYO.2.7.A07.1.454.CMB.2.raw
  modified_base (198)..(198): a, c, t, g, unknown or other
  modified_base (414)..(414): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngccaccctctcctgcagggccagtcagagtattagcagctaacttagcctggtaccagcaagaaacctggaccaggcctcccgaggcctcctcatctatcgctgcactccaccgagggccagtggtactccccgagcccagggttccaggtcggcgtagggtcggggtctgggggactaggtacgtttcagtttccacaccatcagcacgcctgcngtctagtaagtatttagactttaatttattactgtacaggtactaagtaataagtacgtggtacgtacggtcgaaccgaagggacgaaaggtaaacgaaactacgaaacgtacgtgacggaactcgactactagtcctgttactc

SEQ ID NO: 442812 - DNA, 683 bp, Homo sapiens
  misc_feature: GZ8MTXP02J2YK5.2.7.A07.1.454.CMB.2.raw
  modified_base (197)..(197): a, c, t, g, unknown or other
  modified_base (293)..(293): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgcccaccctctcctgcgagggccagtcagagtatagcagcaattgcctaggtaccagcaagaaacctggaccaggcctacccgaggtcctcctnattctatgctgccactccgaccgagggccctagtcggtaacctccccgaggtcctaacggggttcagggtcgggacgtggggtcggggttacctgggggaactaggtcgttcaactttccaccacccagtaccgacgctaacggtccctagccgtagttcgtaagaaacgtttttattacgtaactttaatttcgtacgtgtacgaacgtaataagttaaacttaaaggttacgggtcgggttacggtaaccggtaaccggggaacggtaaaacggggtaaaacgtaaaagggtaaacgtaaaaccgtaaccggtaaaacgtacggtttacggtaacggaaccttaacggaccttaaccgttacgtttaccgttacgtttaccgttaccg

SEQ ID NO: 442813 - DNA, 600 bp, Homo sapiens
  misc_feature: GZ8MTXP02H8SLL.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttagcctggtaccagcagaacctggccaggctcccaggctcctcatctatgctcgcactcccaaccgacgggccacgtggtactcccgagtcctaggttccaggtcggctagggttcggggtcgtgggggactaggtacgtttcgatttccgaccaacccagtccaggcctacgccctgactagtctagaagttattttgacttaattttattacttgtactagactaagtaataaattaacggtgggttacggacggtttacgggaccgtaaaaggggaacccgtaaagggtaacgaaaacttaccgaaaacgaacgttggacggtaactacggacaccgtatccgttacttactttacc

SEQ ID NO: 442814 - DNA, 589 bp, Homo sapiens
  misc_feature: GZ8MTXP02I5NCE.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttgcctggtaccagcagaacctggccaggctcccaggctcctcatctatgctgccactccaccgacgggcctacgtcggtactccccgagccgaggttcaggtgcgtaggtcggggtctggggacaggtagttcattctacactatcagcagcctgctagtctagtaagttatttagacttaaattttattaacgttgtacctagtacctaaagttaattaaagtaacgttagggtcggtaacggttacggaaccgaaaacggggtaaccaaaagggtaaacgaaaacgtaccgaaaaacggtactaggtacggaacttacgaacctaccgtattcctcgttactttaccg

SEQ ID NO: 442815 - DNA, 528 bp, Homo sapiens
  misc_feature: GZ8MTXP02FI5WG.2.7.A07.1.454.CMB.2.raw
  modified_base (323)..(323): a, c, t, g, unknown or other
  modified_base (370)..(370): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagagccaccctctcctgcagggccagtcagagtatagcagcaacttagcctggtaccagcaagaaacctggccaggcctcccaggctcctcatctatgctgcactccaccgagggcccactggtacncccagccaggtcagtggcagtgggtctggggacagtagttcatttcncaccatcagcagctgcagtctagaatatttgacttaatttattactgtcagactaagtataaatacgtggtaggacgtttcggacgtaaggggaccgaaaggtaacgaaatacgaaaacgtaacgtgtaggcgtacgacaccgtatcgtacgtcttac

SEQ ID NO: 442816 - DNA, 628 bp, Homo sapiens
  misc_feature: GZ8MTXP02IO8KR.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccacctctcctgcagggccagtcagagtattagcagcaacttagcctaggtaccagcaagaacctggccaggcctcccaggctcctcatctatgctgcatcccaccgagggccctacgtcggtaactccccgaagtcccgtaggtttccgaagttcgggccgtaggggttcggggttacctgggggaaccaagggtacggtttaccaagttttcccaccaaacccgattccaagtcacggtccctgcagttctaggtaaagtattttcgacttaaatttttacttacgtgttacagtacgtaagttaataaagtaacgttgggtacggtacgttcggaacgtaaacgggaccaaagggtagtaaaaacttacgaaaacgtaaacgtgttacgggaacttacggaactaccctattccttaggttcttaccg

SEQ ID NO: 442817 - DNA, 630 bp, Homo sapiens
  misc_feature: GZ8MTXP02H8KE6.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaagagccaccctctcctgcagggccagtcagagtattagcagcaacttagcctggtaccagcaagaaacctggccaggctcccaggctcctcatctatgctgcatccaccgagggccacgtggtactcccagccaggttcagtggcaggtggtctgggggactaggacgtttcagtttctcaaccatcagcagctagcagtctagaagtactttgacttaaatttttacgttaacttcggtactagtacgtaagttaaattaaattaaaccgttggggttacgggtaaccggtttacccggggaacccgtaaaacgggggtaaaacccgtaaaggggttaaaggaaaaacgttaaccggaaaaaccggtaaaaccgttgggtacggtaacgtacggacccttaacccgtaattccgttacgtttaccgtttaccc

SEQ ID NO: 442818 - DNA, 639 bp, Homo sapiens
  misc_feature: GZ8MTXP02GARTC.2.7.A07.1.454.CMB.2.raw
  modified_base (284)..(284): a, c, t, g, unknown or other
  modified_base (317)..(317): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctnatctatgctgcatccacagggccagtcggtacncccagcctaggttcagtggactagggtcgggtcgtggggactaggtacgttactacgtttccacacctatccgacgacctacgccctgacgtagttacgtaaggtaagttattttacgtaactttaaattttacttactgttacagtactaagttaaattaaacgttaacggttagggttacgggtaaccggtttaccgggaaccggtaaaacggggtaaccgtaaaagggtaaacgtaaaacgtaaaccgtaaaaacgtaacgttaggtaacggtaacgtacgacctaaaccgtacgttaccgttacgtttacctttaccg

SEQ ID NO: 442819 - DNA, 550 bp, Homo sapiens
  misc_feature: GZ8MTXP02G8DGV.2.7.A07.1.454.CMB.2.raw
  modified_base (306)..(306): a, c, t, g, unknown or other
  modified_base (319)..(319): a, c, t, g, unknown or other
  modified_base (367)..(367): a, c, t, g, unknown or other
  modified_base (401)..(401): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccgaggcctcctcatctatgctgcatccaccngggccatggtacncccagccaggttcagtgcaggtgggtctggggacagtagttcattccncacctatcagcacgcctgctagtctagaaagttntttagacttaattttatacttagtctagtactaagttaataagttagtggtaggtacgttcggaccgtaaacgggaccaaagggtaactaaaatacgaaaacgtacgtggtacggtcgtaggacctactagttcgtacgttacttaccg

SEQ ID NO: 442820 - DNA, 541 bp, Homo sapiens
  misc_feature: GZ8MTXP02FLBYP.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaagagccaccctctcctgcagggccagtcagagtattagcagcaacttagcctggtaccagcagaaacctggccaggctcccaggcctcctcatctatgctgcatcccaccagggccactggtactcccagccaggttcagtggcaggtgggtctggggacagtagttcattctcaccatcagcagcctgcagtctagaagtatttgactaaatttatactgtacagctaagtaataactaaatgggtaggtacgtttcggaccaaaaggggaccaaaagggtaacaaaattacgaaaaacgtaactggtacggaactacggacaccctaattcgtcgttctttacg

SEQ ID NO: 442821 - DNA, 523 bp, Homo sapiens
  misc_feature: GZ8MTXP02F603Q.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccatggtactcccagccaggttcagtggcaggtgggtctggggacaggtagttcattcacacctatcagcagccctgcagtcgtagaagttatttgacttaaattttattactgtcagtactagttataatacgtggtaggtacgttcggaccgtaagggtaccaaagggtacgaaaactacgaaacgtaactggtagctgaccacatctgtcttac

SEQ ID NO: 442822 - DNA, 516 bp, Homo sapiens
  misc_feature: GZ8MTXP02FYWI0.2.7.A07.1.454.CMB.2.raw
  modified_base (283)..(283): a, c, t, g, unknown or other
  modified_base (313)..(313): a, c, t, g, unknown or other
  modified_base (356)..(356): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtatagcagcaacttagcctggtaccagcagaaacctggccaggctcccaggctcctnatctatgctgcatccacagggccatgtacnccagccagtcagtgcaggtggtctggggacagagttcatttcncaccatcagcagcctgcagtctagaagtatttgacttaaatttattactgtacaagctaagttataaataacgtggtaggaacgtttcggaccgaaaaggggaccaaaggtaacgaaaatacgaaaacgaactgtaggctgacaacctatctagtcttac

SEQ ID NO: 442823 - DNA, 530 bp, Homo sapiens
  misc_feature: GZ8MTXP02HRSHU.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccagctcctcatctatgctgcatccaccagggccactggactcccagccaggttcagtgcaggtcgggtctggggacagagttcattctcaccatcagcagcctgcagtctagaagtattttgacttaaattttattaacttgtcagtctaagtaataaataacgtggtaggtacgttacggaccgtaaacggggaaccaaagggtaacgaaaattaacgaaaacgactagtaggctagacaccatctcgtacttac

SEQ ID NO: 442824 - DNA, 573 bp, Homo sapiens
  misc_feature: GZ8MTXP02FMVMC.2.7.A07.1.454.CMB.2.raw
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctnatctatgctgcatccacagggccacgtggtactcccagccaggttcagtggcaggtcgggtctggggacaggtagttcatttcacaccatcagcagcctgcagtctagaagtatttgacttaaattttattacgtgtactagactaagttaattaaacgtaagttgggtacggtacggtttaccgggaccgtaaaacgggggacctaaaagggtaaacgtaaaattaacccgaaaacgtaacgttggtaacggaacttacggacctacctacttcgttacgtctttacc

SEQ ID NO: 442825 - DNA, 650 bp, Homo sapiens
  misc_feature: GZ8MTXP02HXFOR.2.7.A07.1.454.CMB.2.raw
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgtaggggaaagacgccaccctctcctgcagggccagtcagagtattagcagcaacttagcctggaccagcagaaacctggccaggctccaggcctccnatctatgctgcactcccgaccgagggccctagtggtaactccccgaaggcccaggggtttaccaggttcggacgtagggttcggggtcgttcgggggaacctaaggtaggtttacctaactttcccaaccgaaccctaacttacgaaggtccaacgtccctgacctaaggtctaaaggtaaacgtttatttacgaactttaaattttattacgttagtacaacgtataaagttaaataaagtaacgtggtacggtacggtacgaacggtaaacgggtaacgtaaaggtaaacgtaaaactaacgaaaacgtacgttacggtacggtaaccgtacgaacctaacgtacttaccgttcgttacctcg

SEQ ID NO: 442826 - DNA, 568 bp, Homo sapiens
  misc_feature: GZ8MTXP02GFOSR.2.7.A07.1.454.CMB.2.raw
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaaacctggccaggctcccaggcctcctcatctatgctgcatcccaccagggccacgtgtactcccagcctaggttcagtggctaggtcggggtctggggacaggtagttcagttctcaccatcagcagcctgcacgttntagaatatttgattaaatttatactgtacagtactaagttaactaaagttaacgttagggtacggtaaccggttccggaaccgtaaaacggggaacctaaaagggtaaacgaaaactacgaaaacgtaactggtacgaacgtacgacctactatacgtacgttacttac

SEQ ID NO: 442827 - DNA, 589 bp, Homo sapiens
  misc_feature: GZ8MTXP02J5OIF.2.7.A07.1.454.CMB.2.raw
  modified_base (302)..(302): a, c, t, g, unknown or other
  modified_base (331)..(331): a, c, t, g, unknown or other
  modified_base (379)..(379): a, c, t, g, unknown or other
tcagacgctcgacacacgaccggtgctcgatttagcacgtgtcgcaggggtaggaactgctcagttaggacccagacggaaccatggaagccccagcgcagcttctcttcctcctgctactctggctcccagatgccactggagaagtggtgatgacgcagtctccagccaccctgtctgtgtctccgagggtaaagacgccaccctctcctgcagggccagtcagagtattagcagcaacttagcctggtaccagcagaaacctggccaggctcccaggctcctcatctatgctgcatccnccagggccactcggatcccagccacgttnacgtggcagtggggttcgtgggaacgagagttcattcttcaacccacncacgcgcgccgcgacgtacgtacgtagtaagttagtttattacttaactttacttacttacgttacgtacgtacgtacgtaacgtaacttaacgtaacggttacggttacgggtacgggtacggtaccggtacggacgaaacggtaaacgtaaacgtaaacgtaaacgtaacgtaacgtaacgtacgtacgtcgtacgtactactactcg

SEQ ID NO: 442828 - DNA, 624 bp, Homo sapiens
  misc_feature: GZ8MTXP02H5U39.2.7.A07.1.454.CMB.2.raw
  modified_base (198)..(198): a, c, t, g, unknown or other
  modified_base (402)..(402): a, c, t, g, unknown or other
  modified_base (421)..(421): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaangcccaccctctcctgcagggccagtcagagtatagcagcaacttagcctggaccagcagaaacctgccaggctcccaggctcctcatctatgctgcatccaccagggcctagtgtactcccagccaaggttcaaggtgactaggtggggtactggggaactaggtagttcaatttccacaaccgtaatccaaagctaacgcccngtcagtcgtagaaagtttntttacgaactttaattttaacttacgttagtacgtaacgtataaagttaaaactaaagttacggtaggggttacggtaaccggttccggaaaacggtaaaacggggaaaacgtaaagggtaaaactaaaacgttaaacgaaaaacgtacgttaggtacggtaaccgtacgaacctacctaagtttccgtacgtttacttaccg

SEQ ID NO: 442829 - DNA, 587 bp, Homo sapiens
  misc_feature: GZ8MTXP02F41GL.2.7.A07.1.454.CMB.2.raw
  modified_base (287)..(287): a, c, t, g, unknown or other
  modified_base (372)..(372): a, c, t, g, unknown or other
  modified_base (513)..(513): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccaggcctcctnatctatgctgcatccaccagggccacgttggactcccagccaggttcagtggcaggtgggtctggggacaggtacgttcatttcncaccatcgagccagccctgcaggtcagtaagtatttgacttaaagtttacttacgtgtacctagtacctaaagttaattaaagtaacgttggggtaggtaaccgttcgggaacgtaaaacgggggacctaaaaggggtaanaaaacgtacgtaaaacggaacgtggtaagggccttacgggaccctaaccgtattaccgttagttcctttaaccg

SEQ ID NO: 442830 - DNA, 712 bp, Homo sapiens
  misc_feature: GZ8MTXP02IFL5X.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaacctgccaggctccgagcctctcatctatgctgcactccaccgagggccctagtggtacctcccgagtccgtaggttccaggtggctagggtcggggttctcgggggaactaggtacgtttccaacgtttccacctaacccgtaattccaaacggtccgtacgtcccgttagtaccgtaacggttcctaaggtaaaagtttacgttttacgaaaccttttaaagtttttaactttacgtttacggttactaagtacgtaaaggtttaaattaaaacgttaaacggttggggttaacggttaccggtttaccggggaaacccgtaaaacgggggtaaaccctaaaagggggtaaacgtaaaaacgttaacccgtaaaaacggtaaacgtttacggtacgggtaacccttaggaaccctaacccgtaatttcccgtacgttttaccttaacccg

SEQ ID NO: 442831 - DNA, 554 bp, Homo sapiens
  misc_feature: GZ8MTXP02GI0RI.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccgaggcctcctcatctatgctgcatcccaccgagggccacgtggtactccccgagccgtaggttcagtcgggactagggttcggggttctgggggacctaggtagtttcatttcctacacctatcagcagcctgcagtctagaagtatttgactaatttatactgtcagtctaagttataaagtacgtggtacggtacgttacggacgtaaagggacctaaagggtacaaaatacgaaaacgtacgtgtaggctagactacctagtctacgttcttac

SEQ ID NO: 442832 - DNA, 632 bp, Homo sapiens
  misc_feature: GZ8MTXP02IB72E.2.7.A07.1.454.CMB.2.raw
  modified_base (196)..(196): a, c, t, g, unknown or other
  modified_base (390)..(390): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctcccagatgccactggagaagtggtgatgacgcagtctccagccaccctgtctgtgtctcgagggggaaanacgccaccctctcctgcagggccagtcagagtatagcagcaacttagcctggaccagacagaaacctggccaggcctcccgaggcctcctcatcctatgctgaccatccccaccgagggccctacgtggtacctccccgagccctaggttccaggtggctaggttcgggtcgtggggactagtacgttcattcncacactcacgcacgccctgactagtctagaagttattttagactttaaattttatacgttgtacagtactaagtaattaaattaacgtgggttacggtaccggtttacggaaccggtaaaaggggaaacccgtaaagggttaaacgtaaaaacgttaaccgaaaaaccggtaacgttaacggtacgggtaaccgttacggaacccgaaccgttacgtttacctttcggtttaccttaacccg

SEQ ID NO: 442833 - DNA, 616 bp, Homo sapiens
  misc_feature: GZ8MTXP02JRTZD.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggcctcccgaggcctcctcatcctatgctgcactcccaccgacgggccctacgtcggtactccccgagtcctaggttcaggtggactagggtgggtctgggggactaggtagttcattcctcaaccctatcagcagcctgctagtctagtaattattttcgacttaaattttacttactgtactagtactaagttaataaattacggttgggtacggtaccgttacgggaaccgtaaaacggggaaccgtaaaagggtaaacgaaaacttaccggaaaaacgtaacgttgggtacggtaacgtacggtaccctaaccgttacgttccgtttacggtacctttaacc

SEQ ID NO: 442834 - DNA, 625 bp, Homo sapiens
  misc_feature: GZ8MTXP02HPS38.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcgagggccagtcagagtatagcagcaacttagcctggaccagcagaacctgccaggcctccaggctcctcatctatcgctgcactcccgaccgacgggcctacgtcggtacctccccgaggtcctaagggttccaggttcggaccgtagggttcggggtcgtgggggaactaggtacgttccagtttccacaccatcgaggcacggtccctagccgtagtcgtaagtaagttagttttacgactttaaattttacttactgtactagtactaagtaattaaacgtacggttgggtacggtacggtacggaaccggtaaaagggaccgtaaaggtaaacgaaacgttaaacgaaacggtaacgtgggtacgaaccgttacgacctaaccgtagttaccgttacgtttacctaccg

SEQ ID NO: 442835 - DNA, 712 bp, Homo sapiens
  misc_feature: GZ8MTXP02JDR73.2.7.A07.1.454.CMB.2.raw
tcagacgctcgacacacgaccggtgctcgatttagcacgtgtcgcaggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccaccctctcctgcagggccagtcagagtattagcagcaacttagcctggtaccagcagaacctggccaggctcccaggccctcctacactctagtcgctgacctactcccgaaccggacgggaccctacgttacggtacctaccccgacgtccgtacggtttaccgaggtcgacgtagggttcggggtcgtacgggggactaggtacgttacctacgtttcctacccgacctaactacgacgtaccgaacgtcccgtacggtactacgttaccggtaaaggttaaagtttacgtttttacgtaaactttaaaagtttttaactttaccgtttacgtacgtacgtaactaaaggtttaaattaaacgttaaacggttggggttacggttaacggttaccgggaacggtaaaaccggggtaaacgtaaaggtaaacgtaaaacgttaaacggaaaaccgtaacgtgggtaacgtaaccgtacggtaaccgaactacgtcgtttaccgtactttaacc

SEQ ID NO: 442836 - DNA, 584 bp, Homo sapiens
  misc_feature: GZ8MTXP02HIN73.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtatagcagcaacttagcctggtaccagcagaaacctggccaggctcccaggctcctcatctatgctgcatccaccgacgggccagtcggtactccccgagtccagggttccagtcggacgaggtcgggtctgggggacctaggtagttcagtttccaccaacctatcagcacgccctgctacgtctaggtaagtattttgacttaagtttatacttgtacagtactaagttaactaaataacgtggtacggtacggttacggaacccgtaaagggggaccaaagggtaaacgaaaagttaccgaaaacggtaactggtacggaactcgaccaacctagttcctagttacctttacg

SEQ ID NO: 442837 - DNA, 571 bp, Homo sapiens
  misc_feature: GZ8MTXP02I42IO.2.7.A07.1.454.CMB.2.raw
  modified_base (196)..(196): a, c, t, g, unknown or other
  modified_base (283)..(283): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccaggctcctnatcatgctgcatccacagggccatggtactcccagccaggttcaggtggctaggtgggtctgggggacaggtacgtttcattctacacctatcagcagccctgctagtctagtaagtctttgactaaatttattactgtacaggtactaagttaattaaataacgttgggtacggtacggttacgggaacccgtaaaggggaaccctaaaaggggtaaacgtaaaacttacgaaaacgtaacgtggtacggtaacctcggacctaaccgatccgtagttacctttacg

SEQ ID NO: 442838 - DNA, 641 bp, Homo sapiens
  misc_feature: GZ8MTXP02GZDON.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttagcctaggtaccagcagaaacctggccaggctcccgagctcctcatctatgctgctactccgaccgagggccctagtcggaactcccgagtcctaggttccagtggacctaggtcgggtactggggtaccaggtacgttccgagtttcctacgtaacccgtattcccgaacggtcctaacggtcccgttagtacccgtacggttaccgtaaggtaaacgttattttacggaacctttaaagttttacgtacgttgtacgtagtacgtaaagttaagtaactacgtggtaccggtacgttacggaaccgtaaggggtaaccctaaggtaacgaaacgttacgaaaacgtacgttcggacggtctacggactaaccgtagttaccgtacgtttacttaaccg

SEQ ID NO: 442839 - DNA, 575 bp, Homo sapiens
  misc_feature: GZ8MTXP02IHS9Z.2.7.A07.1.454.CMB.2.raw
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccgaggcctccncatctatgctgcatccacagggcctagtggactcccagccaggttcagtggcaggtggtctggggacaggtgttcattcacaccatcagcagctgctagtctagaacgtatttgacttaattttatacttgtcagtactagttaataaagttacgtggtacggtaccgttacggaacccgtaaaggggacccgtaaaagggtaaacgtaaaacgtaaccgtaaaaaccggtaacgttggtaacggtaacctacggaacctaccgtaatttccgtacgtttacttaccg

SEQ ID NO: 442840 - DNA, 573 bp, Homo sapiens
  misc_feature: GZ8MTXP02JSVDC.2.7.A07.1.454.CMB.2.raw
  modified_base (386)..(386): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagacgccaccctctcctgcagggccagtcagagtattagcagcaacttagcctggtaccagcagaacctggccaggctcccaggcctcctcatctatgctgcatcccaccgacgggccacgtggtactccccaggtcccaggttccaggtcggactaggtggggtctgggggacaggtacgtttcatttccncaccatcagtacgcctgctagtctagtagtatttgacttaaatttattactgtactagtactaagttataattacgtgggtacggtaccggttacggaccgtaacggggacctaaagggtaaacgaaactacgaaaacggtaacgtggtacggactcggaccacgtactcgtacgttcctactaccg

SEQ ID NO: 442841 - DNA, 512 bp, Homo sapiens
  misc_feature: GZ8MTXP02I7TZA.2.7.A07.1.454.CMB.2.raw
  modified_base (365)..(365): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactccccagccaggttcagtgcagtgggtctggggacaggagttccattcncaccatcagcagcctgcagtctagaagtattttgactaatttattacttgtcagactagtataatacgtaggtgacgttcggacgtaagggacctaaaggtacgaaaatacgaaaacgaactgtaggctgacacagtctcgtcttac

SEQ ID NO: 442842 - DNA, 591 bp, Homo sapiens
  misc_feature: GZ8MTXP02IP2QI.2.7.A07.1.454.CMB.2.raw
  modified_base (199)..(199): a, c, t, g, unknown or other
  modified_base (259)..(259): a, c, t, g, unknown or other
  modified_base (269)..(269): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanagcccaccctctcctgcagggccagtcagagtatagcagcaacttagcctgtaccagcanaactgcagcnccagctctcatctatgctgcatccacagggccatgtactccagccagtcagtgcaggtggtctggggacagtagttcattcacaccatcagcagcctgcaggtctagaagtatttagacttaaatttattaactgttacaaggtactaagttaataaaactaagttagggtacggtacgttacggaacccgtaaaaggggaacccgtaaaagggtaaacgtaaaaaacgttaaccaaaaaaccgggtaaaacttacggttaggggaacccgtttaacgaaacccgtaaaccgtacgtttaccgttacgtttacctttaaccg

SEQ ID NO: 442843 - DNA, 703 bp, Homo sapiens
  misc_feature: GZ8MTXP02F1EAS.2.7.A07.1.454.CMB.2.raw
  modified_base (288)..(288): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagagcccaccctctcctgcagggccagtcagagtattagcagctaacttagcctggtaccagcaagaacctggccaggctcccaggcctccncatctatcgctgccactcccaaccgagggccctaagttcggtacctccccgaagtcccgaggtttccaggtcggactagggtgggtacgtgggggaactagggtagttcacgtttccaccaacctagttccaacggtccacgtcccgtggtacctacggttactaaggtaaacgttattttcggtaactttaaaagttttcttaaccgtgttaccaagggtactaaagttaattaaagttaaccggtggggttacggtaccgggtttaccgggaacccgtaaaagggggtaacccttaaaagggggtaaaccgtaaaaacgttaaaccgaaaaacccggggttaaacttggggtacgggtaaccgttaacggaacctaaacccgtagtttccttaacggtttcctttaaaccccg

SEQ ID NO: 442844 - DNA, 552 bp, Homo sapiens
  misc_feature: GZ8MTXP02HKXRG.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaacctggccaggctcccaggcctcctcatctatcgctgcactcccaccaggggccacgtggtactcccgagccaggttccagtcggcgtaggtcggggttctgggggacaggtacgtttcatttcgtcaccatcagcagccctgctagtctagtaagttactttgacttaaattttattacttgtacagtactagtaattaataacgtgggtagtacggtacgaccgaaagggacctaaagggtaacaaatacgaaaacgtactaggtggaactgaccactatctacgttcttac

SEQ ID NO: 442845 - DNA, 539 bp, Homo sapiens
  misc_feature: GZ8MTXP02FHDV5.2.7.A07.1.454.CMB.2.raw
  modified_base (318)..(318): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggaaagagccaccctctcctgcagggccagtcagagtattagcagcaacttagcctggtaccagcagaaacctggccaggctcccaggcctcctcatctatgctgcatcccaccagggccacgtgtacncccagccaggttcagtggcagtggggtctggggacaggagttcaattctcaccatcagcagcctgcagtctagaagtatttgactaatttattactgtacagtactaagttaataataactggtaggtacgttcggaaccgaagggaacccgaaagggtaacgaaaatacaaaacgtaacgtaggtacggcgtaggaccacctactcgtacgttctttacc

SEQ ID NO: 442846 - DNA, 554 bp, Homo sapiens
  misc_feature: GZ8MTXP02H30UL.2.7.A07.1.454.CMB.2.raw
  modified_base (198)..(198): a, c, t, g, unknown or other
  modified_base (401)..(401): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanacgcccaccctctcctgcagggccagtcagagtattagcagctaacttagcctggaccagcaagaaacctggccaggcctccaggcctcctcatctatgctgcactccaccgagggccagtggtactccagccaggtcagtgctaggtggtctggggacagtagttcattcacacatcagtcagcctgctagtctagaagttntttacgactttaaattttattacgttgtacagtactaagttaaactaagttaacgtggttacggtacgtcggaaccgtaaagggaaacctaaagggtaaacaaagtaacgaaaacgtacgtgtacggctacgacacctattctcgttacttcc

SEQ ID NO: 442847 - DNA, 711 bp, Homo sapiens
  misc_feature: GZ8MTXP02IMM3W.2.7.A07.1.454.CMB.2.raw
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactgggagaagtggtgatgacgcagtctccagcccaccctgtctgtgtctccgaaggggaagcgcccaccctctcctgcagggccagtcagagtattagcagctaacttacgcctaggtaccagcaacgaaaccgtggcccaggcccncccgaggcctcctcatctatgctgaccactcccgaaccgacgggaccctacgtcggtacctccccgagccgtaggttccgaggttcggcgtaggggttcggggtacgtgggggaactaagggttcgtttacctactttacccgacctaacccgtattccgaacgtccacggttccctagacgttacggttcgtaaggttaaagtttctttaagtactttaaaagtttttgttaaccgttgtacgtacgtaacgttaagtttaaagttaaacgttacgggttggggttaaccggtaccgggtttaccggggaaaccggtaaacggggtaaaaccgtaaaagggtaaccgtaaaagtaaaccggtaaaaccgttaaggtcggtacggtaacttacggaacctacctagttccgttacgtttcctaacc

SEQ ID NO: 442848 - DNA, 607 bp, Homo sapiens
  misc_feature: GZ8MTXP02GW3P0.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaagagcccaccctctcctgcagggccagtcagagtattagcagacaacttagcctggtaccagcaagaaacctggaccaggcctacccgaggcctcctacatctatcgctgcactcccaccgacgggcccacgtcggtacctccccagccgtacggttcaggtcggacgtagggtcgggtcgtgggggactaggtacgttctagttccacacctatcgaagtcacgcctgctagtctaggtaagttactttagtacttaaattttattacgttgtacagtactaagttaataaagtacgtggtacgggtacgtacggaaccgtaaagggtaacctaaaggtaaacgaaaactaacgaaaacgtaacgtggtacgaacgtacgacctaacctattcgttacgttactttacc

SEQ ID NO: 442849 - DNA, 511 bp, Homo sapiens
  misc_feature: GZ8MTXP02GES4G.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatccaccagggcccatggtactcccagccaggttcagtggcagtcgggtctggggacaggtagttcattctcaccatcagcagcctgcagtctagaagtatttgactaattttatactgtacagctagtataataactggtagtacgttacggccaaaggggaccaaagggtacgaaatacaaaacgtaactagtcgctagccacatctgtcttc

SEQ ID NO: 442850 - DNA, 551 bp, Homo sapiens
  misc_feature: GZ8MTXP02GE843.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaanagcccaccctctcctgcagggccagtcagagtattagcagcaacttagcctggtaccagcagaaacctggccaggctcccaggctcctcatctatgctgcatccaccagggccacgtggtactcccagccaggttcagtggcaggtgggtctggggacaggtagttcattcacaccatcagcagcctgcagtctagtaagtatttgacttaatttattactgtacagtactaagtataaataacgttggtaggtacgttcggaccgtaaaaggggaccaaaagggtaacgaaaacgtacaaaaacgtacgtaggtaggaactacggacctaacctattcctgttactttaccg

SEQ ID NO: 442851 - DNA, 543 bp, Homo sapiens
  misc_feature: GZ8MTXP02F9GJ7.2.7.A07.1.454.CMB.2.raw
  modified_base (319)..(319): a, c, t, g, unknown or other
  modified_base (371)..(371): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcatccaccagggccacgtggtacncccagccaggttccaggtggcaggtggggtctggggacagtagttcatttcncaccatcagcagcctgcagtctagaagtattttgacttaattttattactgttacagtactaagtaataaagttaacgtggtaggacgtttcggaaccgtaacggggaaccaaagggtaacgaaaatacgaaaacgaactggtaggctagaccaccatactgttacctttac

SEQ ID NO: 442852 - DNA, 529 bp, Homo sapiens
  misc_feature: GZ8MTXP02IYXBQ.2.7.A07.1.454.CMB.2.raw
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggctcccaggcctcctcatctatgctgccatcccaccgagggccacgtggtactccccagccaggtcagtgcaggtgggtctgggggacaggtacgttcattcacaccatcagcagcctgcagtctagaatntttgacttaaatttatactgtcagtcaagttataatacgtggtggtaacgttcggacgaaacgggacaaaggtaacgaaaatacgaaaacgtaactggtacgcgtacgacaccgattcctagtacttac

SEQ ID NO: 442853 - DNA, 517 bp, Homo sapiens
  misc_feature: GZ8MTXP02F2AQL.2.7.A07.1.454.CMB.2.raw
  modified_base (197)..(197): a, c, t, g, unknown or other
  modified_base (316)..(316): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaacctggccaggctcccaggctcctcatctatgctgcatccaccagggccactggtanccagccaggttcagtggcagtgggtctgggggacagagttcattctcaccatcagcagcctgcagtctagtaagactttgacttaaatttattactgtacagctagtactaatactggtagtacgttcggacgtaaacgggaccaaggtacgaaatacgaaacgtaactgtaggaacttcgactacgatctacgttcttac

SEQ ID NO: 442854 - DNA, 602 bp, Homo sapiens
  misc_feature: GZ8MTXP02GA2CA.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggctcccgaggctcctcatctatgctgcactccaccgagggcccacgtcggtactcccaagcctaggttcaggtggctaggtcgggtcgtggggacaggtagttctagttctccaacctatccaagcgagtccctagcagtctagtaagttatttgacttaaatttattacgtgtacagtctaaagttaataaattacgtggtagtaccggttacggaaccgtaaaggggtaaccgaaagggttaaacgaaaacgtaaccgtaaaaacggtaaccgttggtaacggcgttacggtaaccaacccgttattcccgtaggttaccctttaaccg

SEQ ID NO: 442855 - DNA, 506 bp, Homo sapiens
  misc_feature: GZ8MTXP02FE0C8.2.7.A07.1.454.CMB.2.raw
  modified_base (316)..(316): a, c, t, g, unknown or other
  modified_base (359)..(359): a, c, t, g, unknown or other
  modified_base (483)..(483): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtanccagccaggttcagtgcagtgggtctgggacagagttcattcncaccatcagcagcctgcagtctagaagtattttgactaaatttattactgtcagacagtaataaataaactggtaggacgttcggaccaaaaggggaccaaaggtaagaaaatacaaaacgacngtggctgacaccatctgtcttac

SEQ ID NO: 442856 - DNA, 765 bp, Homo sapiens
  misc_feature: GZ8MTXP02I1KD9.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtatagcagcaacttagcctggtaccagcaagaacctggccaggctcccaggctcctcatctatgctgaccatcccaaccgacgggccctaacgtcggtaactccccgaaggcccgtaacgggtttccaggttcgggaccgtaggttcggggttcctgggggacctaagggtacgtttacctaacgtttcccgtaccaaaccccgtaattccgaaacggcccgaacggtccccgttggacctaacggttccgttaagggtaaaacgtttacgtttttagaaacctttaaagttttttaaacgtttaacctttggttacctaaacggttacttaaacggtttaaattaaaagtttaaaccggttaggggttaccgggttaaccgggttttacccgggaacccggttaaaacggggtaaacccggtaaaagggttaaaacggtaaaaacttaaaccgaaaaaccgggtaaaaccgttacggttaagggaaccgttacggaaccctaaaccgtaacttaccgttacgtttacctttaaccg

SEQ ID NO: 442857 - DNA, 555 bp, Homo sapiens
  misc_feature: GZ8MTXP02IU6AU.2.7.A07.1.454.CMB.2.raw
  modified_base (295)..(295): a, c, t, g, unknown or other
  modified_base (382)..(382): a, c, t, g, unknown or other
  modified_base (433)..(433): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctaggtaccagacagaaacctggaccaggctccaggctctcatcatgctncactccacacgggccactcggtactccacgacacgttactagtgcgtaggtggtcgtgggacgagtagtactatactacacatacanacacgactgactacgtacgtagtaagtattatataatttaattacttatanagtactaagtaataataagtaggtagtacgtacgtacgaacggaacgaaaggtaaacgtaaaacgtaaacgtaaacgtaaacgtacgtagtaacgtacgacgactactactacgttacttac

SEQ ID NO: 442858 - DNA, 533 bp, Homo sapiens
  misc_feature: GZ8MTXP02IUFDR.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctaggtaccagcaagaaacctggccaggcctcccaggcctcctcatctatgctgccatcccaccgacgggccacgtcggtactcccagccaggttcagtggcaggtgggtctggggacaggtacgttcattcacacatcagcagccctgcagtctagaagtatttgacttaatttattactgtacagtactagtataagtacgtggttaggtacgttcggacgtaacgggaccaaaggtaacgaaatacgaaacgtaacgtgtaggctacgactacatctgtacttacg

SEQ ID NO: 442859 - DNA, 734 bp, Homo sapiens
  misc_feature: GZ8MTXP02HW9D2.2.7.A07.1.454.CMB.2.raw
  modified_base (197)..(197): a, c, t, g, unknown or other
  modified_base (497)..(497): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggaaanacgcccacctctcctgcgagggccagtcagagtatagcagactaacttagccgtacggtaccaggacaagaaacccgtggacccaacgggccctaccccgaggtccctcctactatccttatcgctgacctaactccccgacgacgggccctaagtcggtaacctcccgagtccgtacggttaccgaggttcggacgtaggttcggggtacgtggggaactaggtaccgtttacaactttccgactaacccactaccgaacgctacgcccctgaccctagttacgtaagtaaacgttttntttaacgtaactttaaattttacgttacgttagtacgaggtaacttaaagttaaacgttaaacggtttacggttagggttaaccggttaccgggttaaccgggaaaaccggtaaaacggggtaaccgttaaaagggtaaaacgtaaaaccgttaaccgtaaaaacgtacggttacggtacggtaaccgtaacgtaaaccctaaccgttacgtttcccgtttaacgtttaccctaccg

SEQ ID NO: 442860 - DNA, 567 bp, Homo sapiens
  misc_feature: GZ8MTXP02HBNBR.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaaacctggccaggcctcccgaggcctcctcatctatgctgcactccaccgagggccacgtcggtaactccccgaggtccagggttcagtggctaggtcgggtacgtgggggacaggtacgttcagtttcacaccctatcagctacgcctgacagttctagtaacgtatttgacttaagtttattactgtacagactagtaataagtagtgggtacggtacgttcggaccgtaaagggtaccaaagggttaacgaaagtacgaaaacgtcgtaggtacggctacggacctacctagtactcgttacttacg

SEQ ID NO: 442861 - DNA, 617 bp, Homo sapiens
  misc_feature: GZ8MTXP02I3H6V.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctacccaggctcctcatctatgctgccatcccaccgagggcccacgtcggtaacctccccgagtcccagggttccaggtcggactaggtcggggttctgggggactaggtagttccagtttcctacaacccgataccgagccagccctgactacggtctagtaagttatttgacttaaattttacgttacttgtaccgagtactaagttattaaataacgtgggttaggtaccgttacgggaccgtaaaacggggtaccgtaaagggtaacgaaaacgttacgaaaacggtaaacgttggtacggtaacgtacggacctaaccgattaccgttacgttacctttacg

SEQ ID NO: 442862 - DNA, 576 bp, Homo sapiens
  misc_feature: GZ8MTXP02GK5V4.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngcccaccctctcctgcagggccagtcagagtatagcagcaacttagcctggtaccagcagaaacctggccaggcctcccaggcctcctcatctatgctgcactccaaccgagggcccacgtcggtaactccccaggcctacggttcagtggctaggtcggggtctgggggacaggtacgttcagttctacaccatcagcagccctgcagtctagtaagtatttgataatttattactgtacagtactaagttaataagtaacgtgggttaggacgttacggaacgtaaacggggtaaccgaaagggtaacaaaacgttacgaaaaacgtaacgtggtacggaacgttacgaccaacctacgtacttacgttctttacc

SEQ ID NO: 442863 - DNA, 547 bp, Homo sapiens
  misc_feature: GZ8MTXP02G5PXZ.2.7.A07.1.454.CMB.2.raw
  modified_base (199)..(199): a, c, t, g, unknown or other
  modified_base (413)..(413): a, c, t, g, unknown or other
  modified_base (536)..(536): a, c, t, g, unknown or other
tcagacgctcgacacacgaccggtgctcgatttagcacgtgtcgctgggggaggaactgctcagttaggacccagacggaaccatggaagccccagcgcagcttctcttcctcctgctactctggctcccagatgccactggagaagtggtgatgacgcagtctccagcccaccctgtctgtgtctccgagggggaaanagccaccctctcctgcagggccagtcagagtattagcagcaacttgcctggtaccagcagaaacctggccaggcctcccaggcctcctcatctatgctgcatcccgacacgggccacgtcggtactccccgagtccgaggttcaggtggctaggtggggtctgggggacaggtcgttcattctaccaccatcagcagcctgcagtctagaagtntttgacttaatttatactgtacaggtactaagttataagtacgttggtacggtacgttcggaccgtaaagggaccgtaaaggtaacgaaacgtacgaaacgtacgtagacgaacgtgacactntctcgtacttc

SEQ ID NO: 442864 - DNA, 536 bp, Homo sapiens
  misc_feature: GZ8MTXP02IG834.2.7.A07.1.454.CMB.2.raw
  modified_base (195)..(195): a, c, t, g, unknown or other
  modified_base (316)..(316): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaanagccaccctctcctgcagggccagtcagagtattagcagcaacttacgcctggtaccagcaagaaacctggccaggctcccaggctcctcatctatgctgcatccacagggccatggtacncccagcctaggttcagtggctaggtcgggtctggggacaggtagttcatttcacaccatcagcagccctgcagtctagtaacgtatttgacttaatttatactgtcagtcagttataatacgtggtgtacgttcggacgtaaagggaccgaaaggttaacgaaaataccgaaaacgtaacgtggtacggaactcggacacctagtccttagtcctttacc

SEQ ID NO: 442865 - DNA, 582 bp, Homo sapiens
  misc_feature: GZ8MTXP02IW0DH.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccgaggcctcctcatctatgctgcatccacagggccactggtactcccagcctaggttcagtggacaggtgggtctggggacaggagttcatttcacgacctatcagcagccctgctagtctagaagttatttgacttaaatttattactgtacagactagtaactaaatacgtggtacggtacgttacggaccgtaaaggggaaccgtaaagggtaaacgaaaaacgttacgaaaaaccggtaaacgttacggtacgggtaaccttacggaaccctacccgtaattccgttcgtttacctttaacc

SEQ ID NO: 442866 - DNA, 638 bp, Homo sapiens
  misc_feature: GZ8MTXP02HEL1Y.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttgcctggtaccagcaagaacctggccaggcctccaggcctcctcatctatcgctgccactcccaccgacgggccctagtcggtactccccaggcctacggttcagtcggctagggttcggggtcgtggggacctaggtacgtttcatttccacacctatcgaacgtcacgcctgcgtagtctagtaagttagttttacgattaaagttttacttacgttagtcgtaagtactaaggttaacttaaacgttaacgttggggtaccgggttacggttaccgggacccgtaaaagggggtaaacccgaaagggttaaacgaaaacgttaaacgtaaaaaccggtacggtttacggacggtcgttacggaacctaccgtaacgttcgttcgttacctttacg

SEQ ID NO: 442867 - DNA, 681 bp, Homo sapiens
  misc_feature: GZ8MTXP02F9LH4.2.7.A07.1.454.CMB.2.raw
  modified_base (384)..(384): a, c, t, g, unknown or other
  modified_base (413)..(413): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaacctggaccaggcctcccgaggcctcctcatctatgctgccatcccgaccgacgggcccacgttacggtacctccccgaaggtccgtaacgggttccaggtcggacgtagggtcggggttcgngggggaccaggtacgtttcacgtttaccnctaacccatccgaagcctaacggcccttaggaccgtaggtttaccgtaaggttaaacgttacgttttacgaacctttaaatttttaacgttacgttggttaacctaaggtacctaaaggtttaattaaacgttaacggttcggggttacggtaaccggtttacggggaaccgtaaaaggggtaaacccgtaaagggtaaacgaaaacgttacgaaaacggtacgtggtacgaacgttacggacctactattacgtcgtttacttaccg

SEQ ID NO: 442868 - DNA, 576 bp, Homo sapiens
  misc_feature: GZ8MTXP02HXY9R.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgccaccctctcctgcgagggccagtcagagtattagcagcaacttagcctggtaccagcaagaaacctggaccaggcctcccgaggcctcctcatctatgctgcactccaccgagggcctacgtcggtactccccgagccctaggttcaggtcggcgtaggtcggggtctgggggacaggtcgttcgatttccacaccatcgagcgacgccctgctagttctagtaagttatttagacttaaattttattacgttagtcaagtactaagttaataaagtaacgtgggtacggtacgttacggaacgtaaacgggaaccgtaaagggtaaacaaaacgtaacaaaacgtactggtagctagacacatctagtactac

SEQ ID NO: 442869 - DNA, 603 bp, Homo sapiens
  misc_feature: GZ8MTXP02G945H.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcaagaaacctggccaggcctcccgaggcctcctcatctatgctgccatcccaccgtacgggcccacgtcgggtaactccccgaaggtccctaaggggtttccaggttcggggcctagggttcggggttctgggggacctagggtacgtttccaatttcaccacctatcagcagtccctgctagtctagtaagtatttgacttaaattttattacttgtctagtactaagtataaataacgtggtaggtacgttcgggaccgtaaacgggaccgaaaggtaacgaaaacgtacgaaaacgtaacgtaggtacggaacgtacggacctaccgtatcgttacgtcctttacg

SEQ ID NO: 442870 - DNA, 566 bp, Homo sapiens
  misc_feature: GZ8MTXP02JZH8Y.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccaggctcctcatctatgctgcatccaccagggcccagtggtactccccagccaggttcagtggcaggtgggctggggacagtagttcattctcacatcagcagcctgcagtctagtaagtattttgacttaatttatactgtcagtactagtaattaataacgtggtaggtacgtttaccgggaccgtaaaaggggaacccaaagggtaaacgtaaaacgttacgaaaaaccggtaacgtaggtacggaaccgtacggacctaaccgtacttacgttcgttacctttaccg

SEQ ID NO: 442871 - DNA, 502 bp, Homo sapiens
  misc_feature: GZ8MTXP02FYBK0.2.7.A07.1.454.CMB.2.raw
  modified_base (196)..(196): a, c, t, g, unknown or other
  modified_base (314)..(314): a, c, t, g, unknown or other
  modified_base (357)..(357): a, c, t, g, unknown or other
  modified_base (415)..(415): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacctggccaggctcccaggctcctcatctatgctgcatccacagggccatggtacnccagccaggtcagtgcagtgggtctggggacagagttcattcncaccatcagcagcctgcagtctgtaagtatttgactaaatttatactgtcagcagtanaattacgtggtgacgttcgccgtaaagggaccaaaggtacgaaaattacgaaaaccgtaactgtaggcgttacacacatctctactc

SEQ ID NO: 442872 - DNA, 611 bp, Homo sapiens
  misc_feature: GZ8MTXP02HSEGW.2.7.A07.1.454.CMB.2.raw
  modified_base (371)..(371): a, c, t, g, unknown or other
  modified_base (424)..(424): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggcctcctcatctatgctgcactccaccgagggcccacgtggtactccccaggcctaggttcaggtcggcgaggtcggggtctgggggactaggngtttcagttcctacacccatcagcagctgcagtcagatatttgacttaatttnttactgtacagtactaagtaattaagtaacgtggggttacggaccggtttacggggaacccgtaaaagggggtaaccctaaaagggggtaaacgtaaaaacgttaccgaaaaaccggtaacgtttgggtacgggccttaacgggacccttaaaccgacgttttacccgttggtttaccctttaaccg

SEQ ID NO: 442873 - DNA, 607 bp, Homo sapiens
  misc_feature: GZ8MTXP02ID8EF.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgccagggccagtcagagtattagcagcaacttgcctggtaccagcaagaaacctggccaggctcccgaggcctcctcatctatgctgcactcccacgagggccagtcggactccccgagcctaggttccaggtcgacgtaggttcggggtctgggggacctaggtacgtttcaacgttccgtacacccgtatcgaagtcacggtcctggactaggttctagtaaagttctttgaactttaattttacttacgttgtacaggtactaaagtaattaagttacggtggtacggtacgttacggaacgtaaacgggtacgtaaagggtaaactaaaacggtacaaaaacggtaccgtggtaacggtcgtacaccgtacacgttcgtactttacctacg

SEQ ID NO: 442874 - DNA, 572 bp, Homo sapiens
  misc_feature: GZ8MTXP02GRT0Q.2.7.A07.1.454.CMB.2.raw
  modified_base (421)..(421): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagccctggtaccagcaacgaaacctggccagggcctcccgaggcctcctcatctatgctgccactccaccgagggcccacgtggtactcccgagtcccaggttccagtcggctaggtgggtctgggggacaggagttcattcctcaccatcagcacgccctgccagtctagtaacgttntttagacttaaattttattacttagtacagtactaagttaataaagtagtgggtggtaacgttcggaaccgtaaagggacctaaagggtaacaaaacgttaacgaaaacgtaacgtgtacggaactacggactaccgatcctacgtcttac

SEQ ID NO: 442875 - DNA, 610 bp, Homo sapiens
  misc_feature: GZ8MTXP02JXZC7.2.7.A07.1.454.CMB.2.raw
  modified_base (354)..(354): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagcccaccctctcctgcagggccagtcagagtatagcagcaacttgcctggtaccagcagaacctggccaggcctcccgaggctcctcatctatgctgcactccacgacgggccactggtactccccagcccaggttcaggtcggcgtaggtgggtcnggggacaggtacgttcagttctacaccatcagtcagccctgctagtctagtaacgttatttcgactttaaatttacttactgtacaggtactaagtttaataaacttaacggtgggttacgggtaaccgtttacgggaacccggtaaaagggtaaacccgtaaaagggttaaacgaaaaacgttaaccgaaaaacggtaccgttaggtaacggaacgtacggacctaaccgttaacgtctttacgtacctttaccg

SEQ ID NO: 442876 - DNA, 607 bp, Homo sapiens
  misc_feature: GZ8MTXP02I8J4T.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccacctctcctgcagggccagtcagagtattagcagcaacttagcctaggtaccagcaagaacctggccaggcctcccaggcctcctacatctatcgctgaccactccccgaccgtacggggcccacgttcggtactccccgagtcccaggttcaggtgactaggtcgggtctggggacaggtacgttcacgttctaccactatcgagtccacggtcctggcctaggtctagtaaacttagttttcgaaactttatttactacgtagtactagtactaagttaataacgtacgtggtacggtacgttcggaacgtaaacgggtacctaaaggtaacgtaaaacgtaccgaaaacgtacgtacggtacggtaactacggaaccaccgttagttaccgtacgttacttacg

SEQ ID NO: 442877 - DNA, 566 bp, Homo sapiens
  misc_feature: GZ8MTXP02H1OGL.2.7.A07.1.454.CMB.2.raw
  modified_base (197)..(197): a, c, t, g, unknown or other
  modified_base (268)..(268): a, c, t, g, unknown or other
  modified_base (347)..(347): a, c, t, g, unknown or other
  modified_base (401)..(401): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccacctctcctgcagggccagtcagagtattagcagcaacttagcctggtaccagcagaactgcagcnccagctctcatctatgctgcactccacgagggccagtcggactcccgagtccaggttcaggtcggctaggtcgggtacngggggactaggtacgttcattcacacatcagcagcctgactagtctagaagttntttgacttaatttacttactgtacagtactaagttaataattacggtggttacgggtaccgttacggaaccgtaaaaggggtaacccgtaaaaggtaacgaaaactaacgtaaaacgtaaacgttcggtagccgtacgactacctagtacgttacgtttactacg

SEQ ID NO: 442878 - DNA, 524 bp, Homo sapiens
  misc_feature: GZ8MTXP02FOZ0O.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtggcagtggggtctggggacaggtagttcattctcaccatcagcagccctgcagtctagaagtatttgactaatttattactgtcagcagtataaataacgtggtaggacgttcggaccgtaaaggggacccaaagggtaacgaaaatacaaaaacgaacgtagtaggcgtagacaccatctacgttcttac

SEQ ID NO: 442879 - DNA, 596 bp, Homo sapiens
  misc_feature: GZ8MTXP02JFVB5.2.7.A07.1.454.CMB.2.raw
  modified_base (456)..(456): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaagagcccaccctctcctgcagggccagtcagagtattagcagcaacttagcctggtaccagacaagaaacctggccaggcctcccaggcctcctcatcctatgctgaccactcccaccgacgggccacgtcggtactccccaggtccaggttcaggtggcgaggtggggtctgggggacaggtacgttcagttcctacaccatccagtcacgtcctgacagtacgtagtaagtattttgacttaaattttatactgtanagtactaagttaataaagttacgtggtacggtaaccgttacggaaccggtaaacgggtaccaaagggttaaacgaaaacttaaacgaaaacgtaaacgtggtacgaacgtacggacctacgtataccttcgtactttacc

SEQ ID NO: 442880 - DNA, 733 bp, Homo sapiens
  misc_feature: GZ8MTXP02G9NIO.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaacctggccaggcctcccgaggcctcctcatctagtcgctgccactccccaaccgacgggccctacgttcggtacctccccgagccccgtaagggtttccgaggttcgggaccgtaggggttcggggtacgtcgggggaacaggtacgtttcgtactttccaccgtaaccctagttccgaacgtccaacggtcccttggacttaacggttccgttaagggtaaacttagtttttacggaaaccttttaaattttttaaccgtacgtttacgtactaaacgggttaaccttaaagtttaaacgttaaaacgtttaaccgggttgggggttaaccggttaaccggggtttaccggggaaaaccgtaaaacgggggtaacctaaaagggggtaaactaaaacgtaaaccggtaaaaccggtaagtcggttacggaacttacggacctaaacgtagtttccttacgttactttaaccg

SEQ ID NO: 442881 - DNA, 581 bp, Homo sapiens
  misc_feature: GZ8MTXP02HP1K7.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtatagcagcaacttagcctggtaccagcagaaacctggccaggcctcccaggcctcctcatctatgcctgccatccccaccgagggcccagtcggtaactccccgagccgtaggttcaggttcggacgtaggttcggggtctcgggggactaggtagtttccatttccacgacctatcacggcacgcctgctagtctagaattctttagacttaatttattactgtacagtcagttaataagtacgttggtaggacgttacgggaccgtaaaggggaccgtaaaggttaaacgaaacgttaacgaaaaccgtacgtaggtagaaccgttgaccacgtatccgttacttcctttac

SEQ ID NO: 442882 - DNA, 548 bp, Homo sapiens
  misc_feature: GZ8MTXP02JYU59.2.7.A07.1.454.CMB.2.raw
  modified_base (197)..(197): a, c, t, g, unknown or other
  modified_base (396)..(396): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaacttagcctggtaccagcagaacctggccaggctcccaggctctcatctatgctgcatccacagggccacgtgtactcccagccaggttcagtggcaggtgggtctggggacaggtagttcagttctacaccatcagcagcctgcagtctagtaagtntttagacttaatttatactgtacagtacaagttaataaagtacgtgggtacggtaccgttacggacccgtaaaggggaccaaagggtaacgtaaaacgttaccgaaaacgtacgtagtaggaacgttagacctacctaatcgtacgtcttac

SEQ ID NO: 442883 - DNA, 558 bp, Homo sapiens
  misc_feature: GZ8MTXP02I6R7C.2.7.A07.1.454.CMB.2.raw
  modified_base (197)..(197): a, c, t, g, unknown or other
  modified_base (283)..(283): a, c, t, g, unknown or other
  modified_base (414)..(414): a, c, t, g, unknown or other
  modified_base (430)..(430): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcacgggccagtcagagtattagcagcaacttagcctggtaccagcagaacctggccaggctccaggctcctnatctatgctgcatccacgacgggccactggtactccccagtcccaggttcaggtggccgtaggtcggggtctgggggacctaggtattccagtttcacaaccatccagcagccctgacagtctagtaagtnttttgacttaaatttnttacgtgtcagtacaagttataatacgtggtggtacgttacgggacctaaaggggacctaaagggtacaaaacgtacgaaaacggtactaggtacgaacgtcgactacctatccgtacgttacttacg

SEQ ID NO: 442884 - DNA, 617 bp, Homo sapiens
  misc_feature: GZ8MTXP02IQ8BU.2.7.A07.1.454.CMB.2.raw
  modified_base (196)..(196): a, c, t, g, unknown or other
  modified_base (447)..(447): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagngccacctctcctgcagggccagtcagagtattagcagcaacttagcctggtaccagcagaaacctgccaggctcccaggctcctcatctatgctgcatccaccagggccacgtcggtactccccgagccctaggtttccaggtggcctaggtcggggttacctgggggaactacggtagtttccatttccgtacaaccagtcaagcacggcctagctacgtctaggaagtagttttcgacttaaatttttntaaccgtttgtaccaggtcctaagttaataaacgttaacgtgggttacggtaccgttcgggacccgtaaaagggggaccctaaaagggggtttaacaaaacgttaacgaaaacggtaaacgttggtacggaacttcggacctaaccgtagtttccctggtttacccttcg

SEQ ID NO: 442885 - DNA, 522 bp, Homo sapiens
  misc_feature: GZ8MTXP02I1IMO.2.7.A07.1.454.CMB.2.raw
  modified_base (379)..(379): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggctcccaggctcctcatctatgctgcatccaccgagggccacgtggtactcccagccagtcagtgcagtggtctggggacagagttcattctcaccatcagcagcctgcngtctagaagtatttgactaatttatacgtgtacagtcaagttataagttaacgtgggtacggtacgttcggaccgtaaagggacctaaagggtagaaaactacgaaaacgtaacgtgtaggctcgacactatctcgtacttcg

SEQ ID NO: 442886 - DNA, 656 bp, Homo sapiens
  misc_feature: GZ8MTXP02HC3MA.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttagcctaggtaccagcaagaacctggaccaggcctcccgaggcctcctcatctatgctgcactccacgacgggcccagtcggtactcccagtcctaggttcagtcggctaggtcgggtcgtggggactaggtcgttactactttcgaccaacctataccgagtccgaacggtcccttggaccgtacgttaccgttaagtaaacgtttacgttttacgtaacctttaaatttttacgtaacgtttggtacctaagggtaccttaaaggttaaacttaaacgttaacggttgggttacggtaccggttaccggaaccggtaaacgggtaaccgtaaaggtaaacgtaaaacgtaacgaaaacgtaacgttcggtaacggaacgtacgaccgtactacgttcgtacgttacctttaccg

SEQ ID NO: 442887 - DNA, 666 bp, Homo sapiens
  misc_feature: GZ8MTXP02JYEY1.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcagggccagtcagagtattagcagactaacttagcctaggtaccagcaagaaacctggaccaggcctcccgaggtcctcctcatctatgctgacactcccaccgacgggccctacgtcggtactccccgagtcctagggttccaggtcggcgtagggtcgggtcgtggggactaggtacgttcagttccacacctatcgaagccacgtccctgacgtacgttacgtaaggtaaagtttacgttttagaaacctttaaagtttttacttacgttagttaccgaagttacctaaagtttaaacgtaaaggtttaaccggttggggttaccgggtaacgtttacccggggaaaaccggtaaaacgggggtaaaccgtaaaagggtaacgtaaaaacgttaccgaaaacggtacgttaggtacggaactacgaccacgtatcgttactcttaccg

SEQ ID NO: 442888 - DNA, 639 bp, Homo sapiens
  misc_feature: GZ8MTXP02GPKKO.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcgagggccagtcagagtattagcagcaacttagcctggtaccagcagaaacctggccaggcctcccgaggcctcctcatctatgctgcactccaccgagggcccacgtcggtactccccgagcctacggttcaggtcggctagggttcggggtcgtgggggactagggtacgtttccaatttccacaaccctatcagcagccctgctaggtctaggaagttattttagacttaaattttattacttgtactagtactaagttaataacgttaaacgtgggttacggtaacggttaccgggaaccggtaaaacggggaaacccgtaaaggggtaaacgtaaaacgtaaccgtaaaaaccggtaacgttacgggtacggaaccgttacggacccgtaaaccctagttaccttcggtttacctttaccg

SEQ ID NO: 442889 - DNA, 553 bp, Homo sapiens
  misc_feature: GZ8MTXP02G5H6X.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaacctggccaggcctcccgaggcctcctcatctatgctgcatcccacgacgggccacgtcggtactcccagccaggttcagtgcagtcggggtctggggacaggtagtttcagtttcacactatcgacgcagccctgactagtctagtaagtatttgacttaaatttactactgtcaggactaagttaattaataacgttgggtggtacgtttacggacgtaacggggacctaaagggtaacgaaaatcgaaaacgtactggtacggctacgactaccagttcgtcttacttacg

SEQ ID NO: 442890 - DNA, 693 bp, Homo sapiens
  misc_feature: GZ8MTXP02IANHS.2.7.A07.1.454.CMB.2.raw
  modified_base (196)..(196): a, c, t, g, unknown or other
  modified_base (261)..(261): a, c, t, g, unknown or other
  modified_base (269)..(269): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggcctcccagatgccactggagaagtggtgatgacgcagtctccagccaccctgtctgtgtctccgaggggaanacgccaccctctcctgcagggccagtcagagtatagcagcaacttagcctggaccagcagaaccngccaggcnccgaggcctcctcatctatgctgcactcccaccgacgggcctacgtcggtaactccccgaggcctagggttcaggtcggactagggttcgggtactgggggacctaggtacgtttccagtttccacaaccctagtacgacgtaccacgtccctggtaccgtaggttaccgtaagtaaacggtttcttttacggtaaaccttttaaatttttaccgttactttaggtaccctaagggtacttaaaggtttaaattaaacgttaaacgggttggggttaaccgggttaaccggtttaccgggaaaacccggttaaaagggggaaacccgttaaaagggtaaaaggtaaaccgtaaaccggtaaaacgtaaccgtttggacggtaacctacggaacctacgtacttccgttacgtttaacccttccg

SEQ ID NO: 442891 - DNA, 625 bp, Homo sapiens
  misc_feature: GZ8MTXP02GXZCX.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcgagggccagtcagagtattagcagcaacttagcctaggtaccagcaacgaaccgtggaccaggcctcccgaggcctcctcatctatcgctgcactccgaccgacgggccacgtcggtactccccgaagtccgtacggttcaggttcggacgtaggggttcgggtacgtgggggacctaggtacgtttaccatttccgaccacctatcaacggcacgtcctagctacgtacgtaggtaaattagttttagactttaaattttacttacgttagtaccagtactaagttaacttaaagtaacgttgggtacgtaacggttcggaaccgtaaagggaccgtaaagggttaaacaaacgttaacaaaacgtacgtaggtacggtaatacggactaccgtattacgtctacctttac

SEQ ID NO: 442892 - DNA, 544 bp, Homo sapiens
  misc_feature: GZ8MTXP02JLVZL.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggtaccagcagaacctggccaggctccaggctcctcatctatgctgcatcccaccgagggccacgtgtactccagccacggttcagtgctaggtcgggtctggggacaggtacgttcatttcacactatcagcacgctgacagtctagaagttatttacgacttaatttattactgtacagactagtaattaaataacgtggtcgtaacgtcggaccgaaacgggacgaaaggtaaagaaagtacgaaaacgtacgtggtaggaactacgacctaccgtatacgttacgtctttac

SEQ ID NO: 442893 - DNA, 517 bp, Homo sapiens
  misc_feature: GZ8MTXP02JKGTJ.2.7.A07.1.454.CMB.2.raw
  modified_base (495)..(495): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccatggtatcccagccaggttcagtgcagtggtctggggacaggagttcatttctacaccatcagcagcctgcagtctgaagtatttgacttaatttacttactgtacagtactaagttataataacgtggtaggacgtttcgaccgaaagggaccaaggtaaacgaaatacgaaaacgaactgtaggntacgacaccatctacgtcttac

SEQ ID NO: 442894 - DNA, 756 bp, Homo sapiens
  misc_feature: GZ8MTXP02FSYTW.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgagggaagagccaccctctcctgcagggccagtcagagtattagcagacaacttagcctaggtaccagcaagaaacctggaccagggcctccccgaggcctcctacattctatcgctgcctactccccaaccgacgggcccaacgttggtacctacccgaacgtccctaacggtttccaaggtcgggacctaagggttcggggttaccgtgggggaaacctagggtaaggtttccctaaagtttcccacgtaacccctaagttccaaacggcccgaaacggtcccccgttaggaacccgtaggggtttacccttaaagggtaaaaggtttatttttacgtaaaccgtttttaaaatttttaaacctttaaccgttggttacccgtaaagggttaacctaaaaggtttaaataaaacggtttaaccgggttaggggttacggtaaaccggtttaccgggggaaacgtaaaacgggggtaaaccggtaaaaggttaaaacgggaaaacttaaaccgaaaacggtaacgtgggttaacggaactacgacctactactactcgttacctttacg

SEQ ID NO: 442895 - DNA, 551 bp, Homo sapiens
  misc_feature: GZ8MTXP02JE62F.2.7.A07.1.454.CMB.2.raw
  modified_base (196)..(196): a, c, t, g, unknown or other
  modified_base (278)..(278): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagcccaccctctcctgcagggccagtcagagtattagcagcaacttagcctggtaccagcaagaacctgcagctccagctcnatctatgctgcactccaccagggccaacgtggactcccgagcctaggttcagtgcaggttgggtctggggacaggtacgttcatttcacaccatcagcagcctgctaggtctagaagtatttgacttaaattttactacgttgtacaggtactagtaataacgtacgttggtaggtaccgttacgggacaaacggggtacaaaggtaacgaaaattacgaaaacggtaacttggtacggctacggaccaaccgtatacgttacgttacttacc

SEQ ID NO: 442896 - DNA, 591 bp, Homo sapiens
  misc_feature: GZ8MTXP02HTQWW.2.7.A07.1.454.CMB.2.raw
  modified_base (197)..(197): a, c, t, g, unknown or other
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcagaacctgccaggcctccaggcctcctcatctatgctgcactccacgagggccagtgtactccagccaggttcagtcggctaggtgggctggggacagtacgttcattcacacctatcagcacgcctgactagtcagtaacgttntttagacttaaattttactacttgtacagtactaagttaataacgttaacgtcgggttacggtaccgttacgggaaccgtaaaacggggtaaacccgtaaagggtaaacgaaaacgttaccgaaaaacggtacgttaagggtacggtaacgtacgaaccctaaccgtaattcccgtacgtttacccttccg

SEQ ID NO: 442897 - DNA, 542 bp, Homo sapiens
  misc_feature: GZ8MTXP02INY63.2.7.A07.1.454.CMB.2.raw
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttgcctggtaccagcagaacctgccagctccagctctcatcatgctgcactccaccagggccactggtactccccgagccaggttccagtcggcaggtggggtctgggggacaggtacgttcaagttctaccaccatcagcagcctgcagtctagaatntttgactaaattttgttacttgtactagtactagtaactaagttactgggtagtacggttcggaaccgtaaagggtaccaaaggtaaacaaaatacgaaaacgtaaactggtagaacgtacgactaccgatcctgtactttac

SEQ ID NO: 442898 - DNA, 560 bp, Homo sapiens
  misc_feature: GZ8MTXP02GM7A5.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctccgaggctcctcatctatgctgcatccaccgacgggccacgtggtactcccgagcctaggttccaggtggactaggtgggtctgggggacaggtacgttcattctacacctatcagcagcctgcagtctagtaatatttgattaatttattactgtctagtactaagtaattaataacgtggtacggtacggttacggacgtaaacgggaccgtaaaggtaacgtaaaactacgaaaacgtaacgtggtacggcgtacgaccgtaccattcgtacgtactttaccg

SEQ ID NO: 442899 - DNA, 644 bp, Homo sapiens
  misc_feature: GZ8MTXP02ILC2M.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcagggccagtcagtagtattagcagcaacttacgcctaggtaccagcaacgaaccgtggaccaggcctacccgaggcctcctacattctatcgtctcgccactacccgaccgacggggcctacgtcggtaacctccccgagtcccgtaggttcaggtcggactaggggtcgggtactgggggactagggtacgtttacacgtttcacaccgatcgaacgcgtacgccttagactacgtacttaggaaagttatttacgtaactttaattttaaacttacgttacgtactagtacttaagttaataacgtttaacggtcggttacggtaccggttacgggaaccgtaaaaggggtaaccgtaaaggtaaacgtaaaactaacgaaaaccgtagtcggaggtctacgactacgtacttcgttacgttcttaccg

SEQ ID NO: 442900 - DNA, 656 bp, Homo sapiens
  misc_feature: GZ8MTXP02I3Q8B.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctccgaaggggaagacgcccaccctctcctgcgagggccagtcagagtattagcagcaacttagcctggtaccagcaacgaacctggccaggcctcccgaggcctcctcattctatgctgcactcccaaccgacgggccaacgttcggtaactccccgaagcccgtagggttcaggttcgggacgtaggtcggggtctgggggacctaggtacgtttcagtttccacaccgtatccagacacgtccgttagactacggtactaaggtaaacgtttattttacgaactttaaatttttaattacgttagtactacggtactaaaggttaattaaaggtaccgttaggggtacggtacggttacccggaaacgtaaacggggaaccgtaaaagggttaacgaaaaacttaccggaaaaacgtacgttggacggtctacggaacctaccgtattaccgtttcgtacctttaaccg

SEQ ID NO: 442901 - DNA, 768 bp, Homo sapiens
  misc_feature: GZ8MTXP02HKBWD.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagttatagcagctaacttagcctaggtaccagacaagaaaccgtggccaggcctcccgaggcctcctacatctatcgctcgacactcccgaccgtacgggccctaacgttcgtaacctcccccgaaggtcccgtaacggggtttcccacggggttcgggaccgtaaggggttcggggtaccgttgggggaaccttaggtaccggtttctacgtttccaaccgtacccagttccgaacgtccgacggtccctggaccgtacgttacgtaacgggttaatttacgtttttacggactttaaaacttttttacgttaaacgttttcggtacgtaacggttaccttaaaggtttaaattaaacggttaaacgggtttggggttaaccgggttaccgggtttacccggggaaaccggtaaaacgggggtaacccgtaaaaggggttaaaaccgaaaacgtttaaaccggaaaaccggttaggttacggggttaacggaaccgttacggaacctaccgtaactttccgtttacggtttacctttaccg

SEQ ID NO: 442902 - DNA, 677 bp, Homo sapiens
  misc_feature: GZ8MTXP02H5Z4T.2.7.A07.1.454.CMB.2.raw
  modified_base (198)..(198): a, c, t, g, unknown or other
  modified_base (488)..(488): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgccaccctctcctgcgagggccagtcagagtatagcagctaacttagcctggtaaccagcaagaaacctggaccacggcctacccgaggtcctccctacattcctagtcgctacgaccacgtaccccgaccggacgggccctacgttcgggtaacctccccgaaggtccctagggtttccaacgggttcgggacgtaggggttcggggttcgtagggggactagggtacgtttcaacgtttccacgacctagtcagtccacgccctgactagtctaaggtaaacgtttntttacgtactttaaatttttacgttacgtagtaccgtaagtactaaagttaaagttaacgttacggtaggggttaaccggtaccggtaccgggaaaccgtaaaacgggtaacgtaaaaggtaactaaaacgtacgtaaaacgtacgtggacgtaacgtacgaacctacgtagttcgtactttacctacg

SEQ ID NO: 442903 - DNA, 563 bp, Homo sapiens
  misc_feature: GZ8MTXP02JNLNP.2.7.A07.1.454.CMB.2.raw
  modified_base (197)..(197): a, c, t, g, unknown or other
  modified_base (283)..(283): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttgcctggtaccagcagaacctggccaggcctcccaggcctccncatcatgctgcatccaccgagggccacgtcggtactccccagcctaggttcaggtggcgtaggtcggggtcgtgggggactaggtacgttcagtttccaccacctatcagcagccctgctagtctagtaagtatttcgacttaattttatacgtgtacagtactagttaataaactacgtgggttacggtacgttacggaccgtaagggtacctaaaggtaacgtaaactaacgaaaacgtacgtagtaggctacgacctacgtattccgtactcttacg

SEQ ID NO: 442904 - DNA, 565 bp, Homo sapiens
  misc_feature: GZ8MTXP02JD7U8.2.7.A07.1.454.CMB.2.raw
  modified_base (427)..(427): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagagcccaccctctcctgcagggccagtcagagtattagcagctaacttagcctggtacccagacaacgaaacctggaccaggcctcccgaggtcctcctacatctatgctgcatccaccgagggccatggtactccagcctaggttcaggtgcgtaggtgggtctggggactaggtagttccagttacctacacctatcagaccacgtcctagcagttcgtagtaagttntttgaacttaattttagtactgtacagtactaagtataaacgttagtgggtacgacggttacgaccgtaaagggacctaaaggtaaacaaagtacgaaacgtacgtgacggtctagacctacgtattctacgtcttac

SEQ ID NO: 442905 - DNA, 603 bp, Homo sapiens
  misc_feature: GZ8MTXP02IVZKH.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaacctggccaggctcccgaggctcctcatctatcgctgcactcccaccgacgggcccacgttggtactccccaggccctagggtttccaggttcggacgtaggtcggggtctgggggaccaggtacgtttccatttcacaacctatcagcacgccctgctagttctagaaagttactttgacttaaatttttattacgttgtacagtactaaagttattaaagtacgttgggtaggtaaccggttcgggaaccgtaaaaggggacctaaagggtaaacgtaaaactacgaaaacggtacgttggtagccgtacgacctaaccgtagtccttacgttacctttcg

SEQ ID NO: 442906 - DNA, 697 bp, Homo sapiens
  misc_feature: GZ8MTXP02GVDLT.2.7.A07.1.454.CMB.2.raw
  modified_base (195)..(195): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaancgccaccctctcctgcagggccagtcagagtattagcagcaacttagcctggtacccagcagaaacctggaccaggcctcccaggcctcctcatctatgctgccactcccgaccgacgggcccacgttcggtacctccccgaacggtcccgtacgggtttccacgggtcgggacctaaggggttcgggggttacgtcggggggaacctagggtacggtttacctaacgtttcctaccaaccctataccgaacgccaaccggtcccctaggaccgtacggttaccttaagggtaaacgttactttttacggaacctttaaatttttacttaaccgtttagtaccctagggtaactaaggttaaataacgttaacggtgggttaggtaaccggtttacgggaaccggtaaaacggggaacccgtaaaagggttaaacgaaaacttaacgaaaaccggtactagggtacgcgtacggaacctacgtacttcgttactctttaccc

SEQ ID NO: 442907 - DNA, 646 bp, Homo sapiens
  misc_feature: GZ8MTXP02JFVXK.2.7.A07.1.454.CMB.2.raw
  modified_base (194)..(194): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctccagatgccactggagaagtggtgatgacgcagtctccagccacctgtctgtgtctccgaggggaaangccaccctctcctgcagggccagtcagtagttatagcagactaacttacgccgtaggtaccagacaacgtaaaccgtcggaccgacggccctacccgaggtcctcctactattctagtcgctcgacctactcccgaaccggacgggaccctacgttcggtacctcccgaacggtccgtacggttcacggtcgacgtagggttcggggtcgtagggggactagggttacgttctacgtttccaccaactagtcgaacgcgacgtcctgactacgtagtaagtaaagtttcgtttacgaactttaaagtttatacgttgtacagtactaagttaataacgttacggtggtacggtacgtacggaacgtaaacgggaacgtaaagggtaaactaaactacgtaaaacgtacgttgggacgtcgtacgacctacgtacttcggtacttacttaccg

SEQ ID NO: 442908 - DNA, 592 bp, Homo sapiens
  misc_feature: GZ8MTXP02HDH39.2.7.A07.1.454.CMB.2.raw
  modified_base (197)..(197): a, c, t, g, unknown or other
  modified_base (269)..(269): a, c, t, g, unknown or other
  modified_base (279)..(279): a, c, t, g, unknown or other
  modified_base (434)..(434): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttagcctggtaccagcagaacctgcaggcnccagctcctnatctatgctgcactccaccgagggcccaagtcggtaactccccaggtcccaagggtttccaggtcggctagggttcggggctcgggggaactaggtacgtttccaatttcaccaacccatcaagccacgccctgactacggtctaggaaagtttntttacgaactttaaattttacttacgtagtacagtataagttaactaagttacggtggtacggtacgtacggaacggtaaacgggaactaaaggtaacgaaacgtaacgaaacgtacgtggacgcgtacgaacctactagttccgtacgttacctacg

SEQ ID NO: 442909 - DNA, 587 bp, Homo sapiens
  misc_feature: GZ8MTXP02IIM3D.2.7.A07.1.454.CMB.2.raw
  modified_base (525)..(525): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccacctctcctgcagggccagtcagagtattagcagcaacttagcctggtaccagcaagaacctggccaggctcccaggctcctcatctatgctgcatcccaccgagggccactcggtactccccgagcctaggttcaggtcggcgtagggtcggggtctgggggacctaggtacggtttcctaagttcctacaccctatcagtcacgcctgacagtctagtaagtatttgactttaaatttattacttgtactacggtactaagttaataattaacgttagggtacggtacgttacggaccgaaacggggtaaccgaaagggtaanaaaacgtacgaaaacgtaacgttggtacgaacgttacgactacgtatacgtcgttacttacg

SEQ ID NO: 442910 - DNA, 556 bp, Homo sapiens
  misc_feature: GZ8MTXP02FU11W.2.7.A07.1.454.CMB.2.raw
  modified_base (197)..(197): a, c, t, g, unknown or other
  modified_base (287)..(287): a, c, t, g, unknown or other
  modified_base (403)..(403): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggcctcccaggctcctnatctatgctgcatcccaccgagggcccacgtcggtaactccccgagcctaggttccaggtcggctaggtcggggtctggggacagtagttcattcacaccatcagcacgcctgacngtctagtaagttatttcgacttaatttacttactgtacagtactaagtaataagtacgtgggtacgtacgtcggaacgaaagggaccaaagggtaacaaacttacgaaaacgtacgtgtacggctacgacctactatcgtacgtactttaccg

SEQ ID NO: 442911 - DNA, 599 bp, Homo sapiens
  misc_feature: GZ8MTXP02IT3ZL.2.7.A07.1.454.CMB.2.raw
  modified_base (289)..(289): a, c, t, g, unknown or other
  modified_base (414)..(414): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagtcaccctgtctgtgtctccgaggggaaagagccaccctctcctgcagggccagtcagagtattagcagcaacttagcctaggtaccagcagaaacctggaccaggcctcccgaggctcctnatctatgctgcatcccacgagggcctagtcggtactcccagcctaggtccagtgctaggtcgggtctggggacaggtacgttcagttccacaccatcagcagcctgactagtctagtaaagtttntttagaactttaatttacttacgttgtacagtactaagttaagttaaagtacggttgggtacggtaccggttacggaaccggtaaacggggtaaaccgtaaagggtaaacgtaaaacgtaacgtaaaaccgtacggttggtacggtaacgtacgaacctacgtacgttcgttacgtttacttacg

SEQ ID NO: 442912 - DNA, 501 bp, Homo sapiens
  misc_feature: GZ8MTXP02FMQ2U.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatcatgctgcatccacagggccactggtactcccagccaggttcagtggcagtgggctggggacagagttcattctcaccatcagcagcctgcagtctgaagtatttgactaatttattactgtcagcagtataataactggtgtacgttcggaccaagggaccaaggtaagaaaatacaaaacgaactgtagaacgtgacaccatactgtacttac

SEQ ID NO: 442913 - DNA, 633 bp, Homo sapiens
  misc_feature: GZ8MTXP02I5QZ0.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagctaacttgcctggtaccagcagaaacctggccaggcctcccgaggctcctcatcatgctgcatcccaccgacgggcctacgtcggtactcccgagccaggttcaggtggacctaggtcggggctgggggactaggtacgttcatttccacgaacctataccgaagtccgaacgccttgacgtacggtactaggtaaacgttagtttttagactttaaatttttaattaccgttaggtacctaaggtactaagttaataaacgttaaacggttgggttacgggtacggttacccggggaacgtaaacgggggtaacctaaaaggggtaaacgtaaaagtaccgaaaacgtaacgtggtaaggcgtacgacctaccgtattaccgtgttacctttacg

SEQ ID NO: 442914 - DNA, 626 bp, Homo sapiens
  misc_feature: GZ8MTXP02HVUQA.2.7.A07.1.454.CMB.2.raw
  modified_base (452)..(452): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgccaccctctcctgcagggccagtcagagtatagcagcaactagcctggtaccagcagaaacctggccaggcctcccgaggtcctcctcaatcctattcgctgcctactccccaaccgagggccctaagtcggtaacctccccgagccctaacgggtttccaaggttcggacgtaggggttcggggtcgtggggaactaggtacgttcctatttccacactatcagcacgcctgactagtcgtagaaagttnttttagacttaaattttagtactagtacagtactaagttaataaacgttaacgtggttaacggtaccgttacggggaacctaaacgggggaacctaaagggtaacaaaacgttacgaaaaccgtagtacggtacggaactacgacctaccgtaattccgtcgtttaccttaccg

SEQ ID NO: 442915 - DNA, 723 bp, Homo sapiens
  misc_feature: GZ8MTXP02HJMTN.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaangccaccctctcctgcagggccagtcagagtatagcagcaacttagcctggtaccagcaagaacctggccaggcctcccgaggcctcctcatcctatcgctgcactcccaccgacgggccctaacgtcggtaacctccccgaggtacctacgggttccaggtcgggactagggttcggggtacctgggggaacctagggtaacgtttcctacgttttacccgacctacccgtaacgttccaacgggtaccaacggtcccttacgggactacggttccgttaaggtaaacgtttacgttttacgtaacttaaaatttttacgttaccgttaggttacctaaggtaccttaaaggttaaacttaaacgttaaacggttcgggggtaacggttaacccgggttaccgggaaccggttaaaacggggtaaacccgtaaaggggttaaaacgaaaacgtacgtaaaaaccggtaccgttaggtacggtaaccgtacggtaccctaaccgtaattccgtacgtttactttaccg

SEQ ID NO: 442916 - DNA, 617 bp, Homo sapiens
  misc_feature: GZ8MTXP02F7MQE.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccatatgccactggagaagtggtgatgacgcagtctccagccaccctgtctgtgtctccgaggggaaagngccaccctctcctgcagggccagtcagagtatagcagcaattagcctggtaccagcagaacctggccaggctccaggctcctcatcatgctgcactcccaaccacggggccacgtcgtactccccgaagccctacggttcgagtggcctaggttcggggtctcgggggacaggttacgttctagttccacacctactacacgacgacgctcgacgtacgtacgtagtaagttatttgtacttaatttaatttacgttagtacgtagtactaagtaataaagttaacgttaggtaggtacggttacggtacggtaaacgggtaaaccgtaaagggtaaaggtaaaacgtaaacgtaaaacgtaaacgtaggtacggtaacgtacgtaagaccccccctagttacctacgttactttaccg

SEQ ID NO: 442917 - DNA, 658 bp, Homo sapiens
  misc_feature: GZ8MTXP02FMC02.2.7.A07.1.454.CMB.2.raw
  modified_base (196)..(196): a, c, t, g, unknown or other
  modified_base (483)..(483): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanagccaccctctcctgcagggccagtcagagtatagcagcaacttgcctggtaccagcaagaaacctggccaggcctcccgaggcctcctcagttctatcgctgccactccccgaccgaggggcccctaagttcgggtactccccgaaggtaccgtaaggggtttaacgcgggacgtaggggttcggggtaccgtaggggaccagggttaacgtttaccaactttcctaaccaccctaagtccgaagtcccgaagtcccctggaccctaggttctaagggtaaacttntttttagaacctttaaattttattaaccgtgtaccagtactaaagttaacttaaagtacgttggggtacgtaccggttacggacccgtaaaaggggtaacctaaaagggtaaacgaaaacgttacgaaaacggtacgtggtacgctaacgacacgtactctcgtccttactaccg

SEQ ID NO: 442918 - DNA, 662 bp, Homo sapiens
  misc_feature: GZ8MTXP02I2FYV.2.7.A07.1.454.CMB.2.raw
  modified_base (196)..(196): a, c, t, g, unknown or other
  modified_base (457)..(457): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtattagcagcaacttagcctggtaccagcaagaacctggccaggcctcccgaggcctcctacatcctatcgctgccactcccaaccgacgggccctaagttcggtactccccaggcccctaagggtttcaacggtcggaccgtaggggttcggggttcctagggggacctaggtacgtttccagtttcccactacgatcgagacacggcctagctagtctaggtaaagttntttacgtaactttaaatttacttacgttagtacctagtaccgtaattaagttaaacgttacgttagggttacgggtaacggtttaccgggaacccgtaaaagggaacccgtaaaggggtaaacgaaaacgttaaccgaaaacgttaaccggtagtacgggtaacgttcgaaccgtaccgtacgttacttacggttcctttaaccg

SEQ ID NO: 442919 - DNA, 568 bp, Homo sapiens
  misc_feature: GZ8MTXP02F0D1S.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccaggcctcctcatctatgctgcatcccaccgagggccacgtcggtactcccgagccaggttcagtggcaggtggggtctgggggacaggagttcgattctcaaccatcagcagcctgactagtctagaagttatttgacttaaatttattactagttcagtactaagtaattaagtaacgttgggtacgtacgttacgggaccgtaaaggggtaacccgaaagggtaactaaaagtaccgaaaacgtaaacgttggtacggaactacggacaaccgtatctcgttactttacc

SEQ ID NO: 442920 - DNA, 613 bp, Homo sapiens
  misc_feature: GZ8MTXP02JFZEM.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanacgccaccctctcctgcagggccagtcagagtatagcagcaacttagcctggtaccagcagaacctggccaggcctccgaggcctcctcatctatgctgcactccaacccgaggggcccacgtcggtaactccccgaagtcctagggttccaggtcggacgtaggtcgggttacgtgggggaactagggtacgttcagtttcacactatcagcgagccctgacagtctagtaagttatttgaacttaatttattacgttagtactagactaagttaataaagtacgtgggtacggtaaccgttacgggaccgtaaaacggggtaccaaaggggttaaacgaaaacgttaacgaaaacggtaacgttgggtacggtaacctaggtaccacctagttaccgttcgtttaccttaccg

SEQ ID NO: 442921 - DNA, 596 bp, Homo sapiens
  misc_feature: GZ8MTXP02FRCD8.2.7.A07.1.454.CMB.2.raw
  modified_base (292)..(292): a, c, t, g, unknown or other
  modified_base (472)..(472): a, c, t, g, unknown or other
  modified_base (579)..(579): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagagcccaccctctcctgcagggccagtcagagtattagcagctaacttgcctggtaccagcaagaaacctggccaggccctcccgaggcctcctnacttctatcgctgcctacgtacccaccggacgggccacgttcgggtaacctcccgacgtcctaggttccaggtcggcgtagggtcgggtacgtgggggaactaggtacgttcctagttcctacacctatcaacgcacgcctagctagtctagtattatttcgactttatttactgtgtanagtactaagtataagtagttggtacggtacgtcgaacggtaacgggaaactaagggtaaacaaacgttaacgaaaacgtacgtgtacgtaacgtaccgactacgttnttccgtatttccgtacc

SEQ ID NO: 442922 - DNA, 554 bp, Homo sapiens
  misc_feature: GZ8MTXP02JVZDY.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatcccaccgagggcccacgtggtactccccgagccaggttccagtcggcaggtggggtctgggggactaggtagttccattccacaccctatcagcagcctgcagtctagagttatttgacttaatttagttactgtacagactagttaattaataacgtggttaggtacgttacgggacctaacggggaccaaagggtaacgaaatacgaaaacgtaactggtacggaactacgaccactaactcgtacgttcttacg

SEQ ID NO: 442923 - DNA, 739 bp, Homo sapiens
  misc_feature: GZ8MTXP02H2I3G.2.7.A07.1.454.CMB.2.raw
  modified_base (197)..(197): a, c, t, g, unknown or other
  modified_base (497)..(497): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccacctctcctgcgagggccagtcagagtatagcagacacttagcctggaccagcaagaaacctcggccaggcctccgaggcctcctccatcctatcgctcgcactcccgaccgacgggccctacgtaggtaacctccccgaacggtccgtaaccgggtttcaagggttcgggacgtaggggttcggggtaccgtggggtaaccgtaggttaaccgtttcaacgtttccaccgaaccctaagttacccgaggtacccacggtcccagggtactacgttacgtaggaaaacgtttttnttttaaacgaacttttaaagtttttacgttacgttacgtacgtaacgtagttaaaagttaaacgttaaaacggttaacgggttacggggttaaccgggttaaccggtttacccggggaaaaccggtaaaacggggtaaaccggtaaaagggtaaacgtaaaacgtaaccggaaaacggtacggttggtaacggtaaccgtaccgaccgtaaaccgtacgtttaccgtttacgttaccctacc

SEQ ID NO: 442924 - DNA, 593 bp, Homo sapiens
  misc_feature: GZ8MTXP02HRIXQ.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaaggtggtgatgacgcagtctccagccaccctgtctgtgtctccgaggggaaagagccaccctctcctgcagggccagtcagagtatagcagcaacttagctggtaccagcagaaacctggaccaggcctcccgaggcctcctcatcctatgctgccactccccaacgagggcccagttcggtacctccccgagtcccgtaacgggttcaggtcggacgtaggttcggggtcgtgggggaacctaaggtacgtttcctaatttccctacaaccctatcacggcacgccctgactagtctagtaagttctttgacttaattttattacgtgtcagtctaagtataaactagtggtacggacgttacggaacgtaaacgggaccgtaaaggtaacgaaaattacgaaaacgtcgtaggtaggaactcgacctactatccgtattcttacc

SEQ ID NO: 442925 - DNA, 682 bp, Homo sapiens
  misc_feature: GZ8MTXP02HHO5H.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccgaggcctcctcatctatgctgcactcccaaccgacggggccctacgtcggtaacctccccgaaggtcccgtacgggtttccagggttcgggaccgtaaggggttcgggggttactcggggggaacctaagggtacggttttccaacttttcccgaccaacctagtcgacggccacggtccctgacctacgttcctaaggtaaagttactttttcgaaactttaaatttttactaccgtttgtaccgtaaggtactaaaggttaataaacgttaacgttgggtacggtaccgtttacgggaaccggtaaaacggggtaactaaacggggtaagtaaaacgtcgaaaaaccgtacgttggtaacggtcctacggacccaacttacgttccgttacgttactttaccg

SEQ ID NO: 442926 - DNA, 545 bp, Homo sapiens
  misc_feature: GZ8MTXP02G4Q6D.2.7.A07.1.454.CMB.2.raw
  modified_base (196)..(196): a, c, t, g, unknown or other
  modified_base (225)..(225): a, c, t, g, unknown or other
  modified_base (281)..(281): a, c, t, g, unknown or other
  modified_base (515)..(515): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagngtattgcagcaaacttgcctggtaccagcagaaacctggccaggctcccaggctcncatctatgctgcatccaccagggccacgtggactcccagccacggttcagtggctaggtggtactggggactaggtagttcattctacgacctatcagcagcctgcagtctagtaaagtatttcgaacttaaatttacttaacgtgttacaggtacctaagtaattaaacgtaacgttgggtagtacgttcggacctaaacgggaccgaaggtaacgaaatacaaacgttaacnggtagctagctacctatacgtctacttacg

SEQ ID NO: 442927 - DNA, 683 bp, Homo sapiens
  misc_feature: GZ8MTXP02JF2ZA.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgcccaccctctcctgcagggccagtcagagtattagcagcaacttgcctggtaccagcaagaacctggccaggcctcccgaggcctcctcatctatcgctgccactcccaaccgacgggcccacgttcggtacctccccgaggtcctacgggttcagggtcggacgtaggggtcgggtactgggggaaccagggtacgtttccaagtttcctaccacccgtatccgacgtcacgtcccgtgacctaggttcgtaaggtaagttacgtttacgtaactttaaagttttaacttaccgtttagtaccgtaggtacttaaagttaacttaaacgttaacggttgggttaaccgggttaccggtttacgggaaccggtaaacggggtaaaccgtaaaggggtaaaacgtaaaacgttaaccgtaaaacgtaacggttaggtacggtaacgttacggaacctaccgtattccgttacgttacctttaccg

SEQ ID NO: 442928 - DNA, 555 bp, Homo sapiens
  misc_feature: GZ8MTXP02G2N5F.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanacgcccaccctctcctgcagggccagtcagagtatagcagcaacttagcctggacagcagaacctgccaggctccagctctcatctatgctgcactcccacgacgggccacgtcggtactcccgagccgtaggttccaggtcggctagggttggggtctgggggactaggtacgttctattccacgacctatcgagcacgcctgctagtctagtaagtatttgattaatttattacgtgtctagtactaagtataagtacgtggtaggtacgtcggaccgaagggtaaccgtaaaggtaaacgaaagtacgaaaacgtacgtaggtacggctaggacctactagttctgttacctac

SEQ ID NO: 442929 - DNA, 640 bp, Homo sapiens
  misc_feature: GZ8MTXP02IPS4U.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttgcctggtaccagcaagaaacctggccaggcctcccgaggcctcctcatctatgctgcatcccaccgagggccactcggtactccccaagccctaagggttccaggtcggctagggttcgggtctgggggaacctaggtacgtttccgaatttccgactaacccaagtccgaagccacggtccctagactaggttcctaaggtaaagttagttttacgacctttaaatttttacttaacgtttgtacctaggtactaaaggttaattaaagtaacgttagggttacggtacggtttacggaaccgtaaaacgggaccgtaaagggtaaacgaaaacgttaacgaaaacgtaacgttggtaggaaccgtgaacctaccgattccgtacgtttactaccg

SEQ ID NO: 442930 - DNA, 528 bp, Homo sapiens
  misc_feature: GZ8MTXP02GTVUZ.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccactggtactcccagccaggttcagtgcaggtgggtctggggacaggtagttcatttctcaccatcagcagcctgcagtctgaagtatttgactaaattttattactgttacagtactaagttataataaacgtgggtgtacgttcggaccgtaaagggaccaaagggtagtaaaatacgaaaacgtactggtaggctacgactaccatctcgtctttacc

SEQ ID NO: 442931 - DNA, 677 bp, Homo sapiens
  misc_feature: GZ8MTXP02HX9BJ.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgccagggccagtcagagtattagcagcaacttagcctaggaccagcaagaaacctggaccaggcctcccgaggcctcctcatcctatcgctgccactcccgaccgacgggccctacgttcgggtacctcccccgaaggtccccgtaagggtttccaagggttcggaccgtagggttcggggtactggggggactaggtacgtttccatttccgcaaccctatccagccacgtccctagctagttctagtaacgttatttagaacttttaaattttattaccgttagttacaggtactaaagttaattaaagttacggttagggtaggtaaccggttacggaaacccgttaaaaggggaacccgtaaaagggtaaacgaaacgttaaacgaaaacggtaacttagggttacgaaccgttacggaacccgtaaccgttacttaccgtttacggtttacctttacccg

SEQ ID NO: 442932 - DNA, 739 bp, Homo sapiens
  misc_feature: GZ8MTXP02I2HXA.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccacctctcctgcagggccagtcagagtattagcagcaacttagcctggtaccagcaagaacctggaccaggcctacccgaggcctcctcattctatgctcgcctactcccaaccgacgggccctaacgttcggtacctccccgagtcccgtagggtttccagggtggaccgtaggggttcggggtcgtgggggaacctagggtacgtttacctacttttccaccgtacctaacgttcgaacggacccgaacggtcccgttagggtaccctaacgggtttaccttaaggtaaaggtttactttttacggaaacttttaaaactttttacgtttaaccgtttggtaaccctaaggttacctaaaaggtttaaacttaaaggttaccggttaggggtacgggttaaccggtttaccggggaaccggtaaaacgggggtaccgtaaaaaggggtaaacgtaaaaaccgttaacgaaaacggttaaacgttgggtacggtaacctacggaacctaaccgtagtttccttacgttacctttaaccg

SEQ ID NO: 442933 - DNA, 673 bp, Homo sapiens
  misc_feature: GZ8MTXP02JU2XV.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaanacgcccaccctctcctgcagggccagtcagagtatagcagactaacttagcctaggtaccagacaagaaccgtggaccaggcctcccgaggtcctcctcatctatcgctgccactccccacgacgggccctacgttggtaacctccccgaggtccgtaaggttccaggttcgggacgtaggggttcggggtcgtgggggaactagggttacgttactatttccacctaacctagtcgacgtcgaccgtcccgtagacgtacggttactaaggtaaagtttattttacgaactttaattttaacttacgtgtacctagtactaagttaattaagtacggttagggtacggtaacgttaccggaacggtaaacgggtaaaccgtaaggtaaaacgtaaacgtaaaccgaaaacggtacgttaagggtaccggtaacgtaccggacctaaccggtattaccgttcgtttaccttcccg

SEQ ID NO: 442934 - DNA, 564 bp, Homo sapiens
  misc_feature: GZ8MTXP02I2EFD.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggctcccaggctcctcatcatgctgcactcccaccgacgggccactcggtactccccagccaggttcagtggctaggtgggtctgggggacaggacgttcatttctacacctatcagcaagccctgcgagttctagaagttatttgacttaatttattactgtcagtactaagttaataacgtagtagggtcggtacgttaccggacgtaaacggggactaaaagggtaacgtaaaacgtacgtaaaacgtactaggtacggaactcgacacctagtccttacgttacctttacg

SEQ ID NO: 442935 - DNA, 548 bp, Homo sapiens
  misc_feature: GZ8MTXP02IS0WK.2.7.A07.1.454.CMB.2.raw
  modified_base (199)..(199): a, c, t, g, unknown or other
  modified_base (371)..(371): a, c, t, g, unknown or other
  modified_base (376)..(376): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanagccaccctctcctgcagggccagtcagagtattagcagcaaacttagcctggtaccagcaagaaacctggccaggctcccaggctcctcatctatgctgcatcccacacgggccacgtcggtactccccagccagggttcagtggcaggtgggtctggggacagacgtttnattcncacatcagcagcctgcagtctagaatattttgacttaatttattactgtacagtacagttaataaagttaacgtgggtacggtaacgtttcggaaccgtaaaaggggaccaaaggtaaagaaactaacgaaaaccgtaacgtggtaggctagaccacactctagtactttcg

SEQ ID NO: 442936 - DNA, 653 bp, Homo sapiens
  misc_feature: GZ8MTXP02HKI4N.2.7.A07.1.454.CMB.2.raw
  modified_base (195)..(195): a, c, t, g, unknown or other
  modified_base (462)..(462): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctcgaggggaaancgccacctctcctgcgagggccagtcagagtatagcagctaacttagcctaggtaccagcaagaaacctggaccaggcctcccgaggcctcctcatctatcgctgacactacccaccgaggggaccctagtcgggtaacctccccgaagtcccgtaacgggtttcaaggttcggacgtaggggttcggggtcgtgggggaacctaggtacgtttcaagtttccacaacccatccgaagcacgccgtgccgaagtctaaggaaagttnttttacgactttaaattttacttacgttgtactaagtactaaagttaaataaacgttaacggttgggtaacggtaccggtttacgggaaaccgtaaaacggggaaacccgtaaaaggggtaaactaaaacgtaacgaaaacgtacgttaggacgaacgtcgaacctaccgtattccttacgttacttaccg

SEQ ID NO: 442937 - DNA, 618 bp, Homo sapiens
  misc_feature: GZ8MTXP02F5DE5.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtattagcagcaacttagcctggtaccagcagaacctggccaggcctcccaggcctcctcatctatgctgcactcccaccgacgggccctacgtcggtactccccgagtccctagggttcaggtgcgaggtcggggtctgggggacaggtagttaccatttcgcaacctatcgaacgcacgcctgactagtctagtaagttatttacgacttaatttacttacgtgtactagtactaaagttaactaaagttacgttgggtacggtaaccggtttcgggaaccgtaaaacggggtaccgtaaaagggtaaacgtaaaacgttaccgaaaacggtaacgtacggtacggtaaccgtaggaccctaacgtacttacgttcgttactttaacc

SEQ ID NO: 442938 - DNA, 672 bp, Homo sapiens
  misc_feature: GZ8MTXP02GFYB9.2.7.A07.1.454.CMB.2.raw
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcagaacctggccaggctccgagctcctnatctatgctgcactcccaccgacgggccacgtcggtactcccgagcctaggttccaggtggactagggtcggggtactgggggaacctagggtacgtttaccaatttccacctaaaccctattacccgaaacggtccaacgggtccctgaccgtacggttaccgtaaggtaaacgtttattttagtaacctttaaatttttaaacttaccggttatacgtaagtactaaagttaaattaaacgttaacggttaggggtacggtaaccggtttaccggggaacgaaaacgggggtaaaccaaaagggttaaacgaaaacgttaaccgaaaaacggtacgtggtaacgccgttacggaacctaccggtaattccgttacgttactttacc

SEQ ID NO: 442939 - DNA, 603 bp, Homo sapiens
  misc_feature: GZ8MTXP02HN4RC.2.7.A07.1.454.CMB.2.raw
  modified_base (277)..(277): a, c, t, g, unknown or other
  modified_base (312)..(312): a, c, t, g, unknown or other
  modified_base (399)..(399): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgccaccctctcctgcagggccagtcagagtatagcagcaattagcctggaccagcagaacctgcaggcctccagcctcnatctatgctgcactcccacgagggccagtcgtacncccagccaggttcagtgcgtaggttcggcgtggggactagacgtttcattcaccaccatcagcacggcctgctaggtctagaagttntttcgaactttaattttacttacgttgtactaaggtataaaggttaaataaagttaaaccggttggggttaacgggtaaccgttacgggaaacccggaaaagggtaaacccgttaaagggaaacttaaaaaccgaacgtaaaaccgtaaacgttggtacggaacttacggaaccgtacctaattcgtacgttttacctaacccg

SEQ ID NO: 442940 - DNA, 745 bp, Homo sapiens
  misc_feature: GZ8MTXP02I942W.2.7.A07.1.454.CMB.2.raw
  modified_base (198)..(198): a, c, t, g, unknown or other
  modified_base (293)..(293): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcgagggccagtcagagtatagcagctaacttgcctggtaccagcaagaacctggccaggcctacccgaggtcctcctnactctatcgctgactactccccgaacgagggtccctacgtcggtacctcccgagccgtacgggttcacggtggccgtagggttcggggtctgggggactaggtacgtttcctaagtttccaccgtaccctagtccgtaaacgccgtacgtcccgttagacccgttagggttaccgtaaggttaaagtttacgtttttacggtaaactttaaacgttttaaacgttcccgttagttaccgtaacggtaaacccttaaaggtttaaaccgttaaaacggtttaccggtaggggttaacccggggttaaacggttacccggggaaaccggtaaaacgggggtaaacccttaaaaggggttaaacgtaaaacgtaaccggtaaaaacgggtaacttcggggtaacgtaaccttacggaaccctaccggttattcccgttacgtttcccttaaccgg

SEQ ID NO: 442941 - DNA, 592 bp, Homo sapiens
  misc_feature: GZ8MTXP02G56YB.2.7.A07.1.454.CMB.2.raw
  modified_base (197)..(197): a, c, t, g, unknown or other
  modified_base (282)..(282): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctcttctgcagggccagtcagagtattagcagcaacttagcctggaccagcagaacctggccaggctccaggctcctnatctatgctgacatcccaccgacgggcctactcggtacctccccgaggtcctacggtttccgaggtcggactaggggttcggggtctgggggactaggtcgtttactactttcgcaacccatccagcagccctgactagtactaggaaagttcgttttagaatttaatttattacttgtactagactaagttaaataagtaaacgttgggtacggtacgttacggaaccgtaaaggggaccgtaaaggtacgaaaataccggaaaacggtagtaggttaggctaggaccacgtatccgttagtacttacc

SEQ ID NO: 442942 - DNA, 697 bp, Homo sapiens
  misc_feature: GZ8MTXP02FTHOB.2.7.A07.1.454.CMB.2.raw
  modified_base (194)..(194): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgagggaancgccacctctcctgcagggccagtcagatatagcagctaacttgcctggtaccagacaagaaacctggccacggcctcccaggcctcctcatctatcgctgcactccacgacggacccatcggtactcccgagtccgtaggttacgaggtcggacgtaggttcggggtcgtgggggactaggttacggttactacgtttacctaccaacctacttaccgacgaccgtaacgtccgtggtacctacgttagtaggttaaacggttattttacgtaactttaaattttaactttacgtaggttacctaagtaccgttaaagttaaattaaacggtttaaccgtagggggttacggttaaccgggtttaccggaaaccgggttaaaacggggtaaacccggtaaaaggttaaaacgaaaacgtttaaaccgaaaaacggttaacgttacggggtacgtaaccgtacggtaacctacgttaaccgttcttacggtttctttaacccg

SEQ ID NO: 442943 - DNA, 703 bp, Homo sapiens
  misc_feature: GZ8MTXP02JE0SE.2.7.A07.1.454.CMB.2.raw
  modified_base (199)..(199): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagngcccaccctctcctgcagggccagtcagagtattagcagcaacttagcctggtaccagcagaacctggccaggctcccagcctcctnatctatcgctgccactccgaaccgacgggcccaacgttcggtacctccccgaaggtcccgtaagggtttccaggttggaccgtaggggttcggggtactgggggaacctagggtacgtttcaatttcctaccgaaaccctagttccgaacgtccaacggtccctaggactacggttcgttaaggaaaagttatttttacggaacctttaaaatttttacgttaaccgttgttaccgtaaggtactaaaggttaaacttaaacgtaacggttgggttacgggtaccgttaccggaaccggtaaaacggggtacctaaaagggggttaaacaaaacgttaccgaaaacgtaaaacggttcggtaagggtaacctacggtaacctaaacccggtagtttaccttcggtttacctttaccg

SEQ ID NO: 442944 - DNA, 775 bp, Homo sapiens
  misc_feature: GZ8MTXP02J0S38.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggcctccagatgccactggagaagtggtgatgacgcagtctccacgccaccctgtctgtgtctaccgaaggggaagacgcccaccctctcctgcgacgggccagtcagagtatagcagactaacttagcctaggtaccagaccgaagaaacccgtggaccgacggccctacccgacggtcctccctacacttctatgctgccactccccgaaccgacgggccctacgtggtacctccccgacggaccgtacgggttccagggttcgggacgtaggggttcggggtacgttgggggaacctaagggttacgtttacctacgtttaccctaccaacccgtacgtaccgaacggaccctaacgggtcccttaggacttaacggtttaccgtaagggttaaaacgttttgtttttacgaaacctttttaaagtttttaacttaaccgttgtaaccgtaagggtacctttaaagttaaaacgttaaaacggttacgggtttaggggtaaccgggttaccgggttaaccggaaaccgggttaaacggggaaacccgtaaaaggggtaaacgaaaaacgttaaccggaaaaacggttcgttacggtacggaaccttaaccggactaaaaccttcgttccgtttacgttacctttacccg

SEQ ID NO: 442945 - DNA, 557 bp, Homo sapiens
  misc_feature: GZ8MTXP02IVOXK.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggcctcccaggcctcctcatctatgctgcatccaccagggccactcggtatcccagcctaggttcagtggctaggtggggtctgggggacaggtacgttcattcctacacccatccagcagccctgctagtctagaagtatttgacttaaattttatacttgtacagtactaagttaattaaataacgtggttacggacgttacggaaccgtaaaaggggaccaaagggtaacaaaagtacgaaaacgacttggtaggaacctagacctaacctatacttgtactttac

SEQ ID NO: 442946 - DNA, 581 bp, Homo sapiens
  misc_feature: GZ8MTXP02FJ5OC.2.7.A07.1.454.CMB.2.raw
  modified_base (196)..(196): a, c, t, g, unknown or other
  modified_base (409)..(409): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanacgccaccctctcctgcagggccagtcagagtattagcagcaacttagcctggtaccagcaacgaaacctggccagggcctccccgaggcctcctcattctatgctgccactcccaccgagggcccacgtcggtactcccgagcctaggttcaggtggcgtaggtcggggtctgggggacaggtagttcatttcacacatcgagcagcctgcngtctagtattatttgacttaaatttattactgtactagtactaagttaactaagtaacgttggtacggtacgttcgggaccgaaagggtaccgaaagggttaaacgaaaatacgaaaacgtaacgtcggtacggtaactacggacctactacgttcgttacgtttccttacg

SEQ ID NO: 442947 - DNA, 607 bp, Homo sapiens
  misc_feature: GZ8MTXP02H7UT6.2.7.A07.1.454.CMB.2.raw
  modified_base (195)..(195): a, c, t, g, unknown or other
  modified_base (250)..(250): a, c, t, g, unknown or other
  modified_base (267)..(267): a, c, t, g, unknown or other
  modified_base (277)..(277): a, c, t, g, unknown or other
  modified_base (408)..(408): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaanagccacctctcctgcgagggccagtcagagtatagcagctaattagcctggaccngcagaacctggccagcnccgagctccncatctatgctgcatcccacgagggcctagtggtacctcccagccgtaggttccaggtggctaggtggggtctggggactagtagttccagttctacaccatcagcagccctgccgtagtctagtaaagttntttgacttaaattttcttaacgtgttacaggtactaaagttaataaagttaacgtagggttaggtaaccgttcgggaaccgtaaaaggggtaacctaaaaggggtaaactaaaaacgttacgtaaaaacccggacgtttaggtacggaaccgttacggaaccctaacccggatttacccggtttcgttaccctttaccg

SEQ ID NO: 442948 - DNA, 558 bp, Homo sapiens
  misc_feature: GZ8MTXP02GLBYS.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggctccaggcctcctcatctatgctgcactccaccgagggcccacgtcggtactccccagcctaggttccaggtggcgtaggtcgggtcgtgggggacaggtacgttcattctcacctatcagcagtcctgactagtctagaagttatttcgacttaatttacttacttgtacagtactaagttaactaagtaacgtgggtagtacgttcggaacgtaaagggaacaaaggtaacgaaaactacgaaacgtaacgtggtacgcgtacgacacctgtactcgttcttacc

SEQ ID NO: 442949 - DNA, 660 bp, Homo sapiens
  misc_feature: GZ8MTXP02IVKVY.2.7.A07.1.454.CMB.2.raw
  modified_base (194)..(194): a, c, t, g, unknown or other
  modified_base (280)..(280): a, c, t, g, unknown or other
  modified_base (369)..(369): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccatggagaagtggtgatgacgcagtctccagccaccctgtctgtgtctcgaagggaaancgccacctctctgcagggccagtcagagtatagcagcaacttgccgtggtaccagcaagaaacctggccaggcctccaggcctccncatctatcgctagcactcccaaccgagggcccacgtggtaactccccgaaggtcctaggttccaggttcgggactaggtggggttccgngggggaactaggtacgtttacaacgtttccactaaccgtaactcaggtcacggcccttaggactacgtacgtagtaaacgtttagttttacggaatttaaacgttttagttaaacgtttcgtacgttaacgtacgtaaagttaaagttaaaacttaaggttcgggttacggtaaccggtttacggaaacccggtaaaacgggtaaccgtaaaaggtaaacggtaaaacttaaacgaaaaccgtaaagttcgaaacggtctagaccgactacgtcgttacgtactttaaccg

SEQ ID NO: 442950 - DNA, 575 bp, Homo sapiens
  misc_feature: GZ8MTXP02H0WSZ.2.7.A07.1.454.CMB.2.raw
  modified_base (196)..(196): a, c, t, g, unknown or other
  modified_base (285)..(285): a, c, t, g, unknown or other
  modified_base (322)..(322): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaaancgccaccctctcctgcagggccagtcagagtatagcagcaacttgcctggaccagcaagaaacctggccaggcctcccgaggcctcctnatctatgctgcactcccacgtagggcctacgtgtacncccagcctaggttcagtgcaggttgggtctggggactagtacgttcatttccacacctatcagcagcctgctagtctagaagttatttacgactttaatttacgttactgtacaggtacaataataaagttacgtgggttacggtacgtacgggaactaacggggtaacaaaggggttaaacaaacgtaaccgtaaaacggtactaggacggtaacgtcgaaccgtactaacgttcgtttacgttctttaacg

SEQ ID NO: 442951 - DNA, 589 bp, Homo sapiens
  misc_feature: GZ8MTXP02FRMDY.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctccaagatgccactggagaagtggtgatgacgcagtctccagccaccctgtctgtgtctccgaggggaaagagccaccctctcctgcagggccagtcagagtattagcagcaacttagcctggtaccagcagaacctggccaggctccaggctcctcatctatgctgcactccaccgaggggcccacgttcggaactccccgaggcctaggtttccaggtggctagggtggggtactgggggaccaggtagttcattctacaccgtatcacgcacggccctgccagttcgtagtaacgttatttcgacttaaattttacttactgtacaaggtactaagtaacttaaagtaacgttgggtaggtaacggttcggaccgtaaacggggaaccctaaagggtaaacaaaacgtacgaaaacgtacgtagttacgggaactacgacctaccagtcctgtactttac

SEQ ID NO: 442952 - DNA, 563 bp, Homo sapiens
  misc_feature: GZ8MTXP02F4YSR.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggctcccaggctcctcatctatgctgcatccaccagggccagtgtactccagcctaggttcagtggcagtgggctggggacaggtagttcattcacacatcagcagctgcagtctagtaagtattttgacttaatttattactgttacagtactaagttataagtaacgttgggtacggtaacggtttcggaacccgtaaaggggtaaacccgaaagggttaaacgaaaacgttacgaaaaccgtaacgttggtacggcgttacgactaccctagtcgttacgtactttaccg

SEQ ID NO: 442953 - DNA, 558 bp, Homo sapiens
  misc_feature: GZ8MTXP02I5R3X.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaactggccaggctcccaggctcctcatctatgctgcatccaccagggccactggtactccccagccaggttcaggtgacaggtcggggtctgggggacaggtacgtttcagtttcctacaccctatcagcagcctgcagtctgaagtatttgactaaatttattactgtacagtactaagttaataaattaacgtaggttaggacgtttacgggaccgtaaaggggaacccaaagggttaacgaaaattaacgaaaacgtaacgtaggtaggaacgttgacacctatccgtagtcttacg

SEQ ID NO: 442954 - DNA, 757 bp, Homo sapiens
  misc_feature: GZ8MTXP02H2M3B.2.7.A07.1.454.CMB.2.raw
  modified_base (197)..(197): a, c, t, g, unknown or other
  modified_base (282)..(282): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccacctctcctgcagggccagtcagagtattagcagcaacttgcctaggtaccagcagaacctggccaggctccaggctctcntctatgctgcactccacgacgggcctacgtcggtaacctccccgaaggtccctagggtttccacgggttcgggctagggttggggttcctgggggaacctaagggtacggttttaccaactttttccaccgtaaaccctagtacccaacggtaccaacggtcccctaggacccgtaagtttccggtaaggttaaaacgtttgtttttacggaaaccttttaaaattttttacggtttaaacctttcggttaacttaacggtaccttaaaaggtttaacttaaaacgtttaaaccggtgggggtttaaccgggttaaccggtttacccggggaaaccggtaaaacgggggtaaacccgtaaaagggggtttaaaacaaaaaccggttaaacggaaaaaccggtaacgtttaacgggtacgggtaaccttaaccgggaaccctaccggtactttccgttacggtttaacccttcccg

SEQ ID NO: 442955 - DNA, 504 bp, Homo sapiens
  misc_feature: GZ8MTXP02F6MNZ.2.7.A07.1.454.CMB.2.raw
  modified_base (281)..(281): a, c, t, g, unknown or other
  modified_base (284)..(284): a, c, t, g, unknown or other
  modified_base (287)..(288): a, c, t, g, unknown or other
  modified_base (290)..(290): a, c, t, g, unknown or other
  modified_base (307)..(307): a, c, t, g, unknown or other
  modified_base (319)..(319): a, c, t, g, unknown or other
  modified_base (321)..(322): a, c, t, g, unknown or other
  modified_base (329)..(329): a, c, t, g, unknown or other
  modified_base (339)..(339): a, c, t, g, unknown or other
  modified_base (351)..(351): a, c, t, g, unknown or other
  modified_base (354)..(354): a, c, t, g, unknown or other
  modified_base (391)..(391): a, c, t, g, unknown or other
  modified_base (395)..(395): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctccagctccnatntanntncatccacaggcatgtanccagcagtcagngnngtggtgnggagagagtnatctcacatcancanctgcatctagtagtatttgtactaatttattattgtnaganataataaataaacgtaggtaggtacgtcgtaccgaaacggaacgaaaggtaaagaaaagtaaacaaaacgaaaacgtagtaggtcgtagacaccactactacgtcttac

SEQ ID NO: 442956 - DNA, 604 bp, Homo sapiens
  misc_feature: GZ8MTXP02I0DN1.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaagacgccaccctctcctgcagggccagtcagagtattagcagcaacttagcctggtaccagcaagaacctggccaggctcccgaggcctcctcatctatgctgcctatcccaccgagggccctacgtcggtactccccgaggccctaggttccaggtcggacgtagggtcggggtcgtgggggactaggtagtttccagtttccacaccatcagcacgccctgcctagtctagtaattactttgactttaaattttattacgtgtactagactaagtaattaaagtacgtgggttacggtacggtacggaaccgtaaaacggggtaccaaaaggggtaacaaaacgtacgaaaacgtacgttggtacggtaaccgtcgacctaacctagtttccttacgttacctttaccg

SEQ ID NO: 442957 - DNA, 614 bp, Homo sapiens
  misc_feature: GZ8MTXP02JLMJ4.2.7.A07.1.454.CMB.2.raw
  modified_base (400)..(400): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcaagaacctggccaggcctcccgaggtcctcctcatctatcgctgaccactccccgaaccgtacggggcctacgtcggtactcccgacgccgtaggtccagtcggcgtaggtcgggtcgtgggggactaggtagttcacgttcnccacgatcgtacgacacgcctagctacgtactagtaagtactttagtacttatttattacgttagtactagtactaagttattaaagtacgttggtacggttacggtacggaaccggtaaaacggtaaccgaaaggtaaacgaaacgtaacgtaaaacgtaacgtaggtacggtaacgtacgtaccgacgtacgtaccgttacgttactttacg

SEQ ID NO: 442958 - DNA, 771 bp, Homo sapiens
  misc_feature: GZ8MTXP02JSRH3.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagngccaccctctcctgcagggccagtcagagtattagcagctaacttagccctggtaacccagacaagaaaccctggccagggccctcccgaggtcctccctcatctatcgctgccactcccaccgtacgggaccctacgtcggtactccccgagtcccaggttcaggtggacgtaggttcggggtcgtgggggactagggtacgttccaagtttccacccaaccgtacttaccgaacgtaccgaacggcccttggaccgtaggttaccgtaaggtaaacgtttagtttttacgtaaacctttaaaattttttaacgttaccgttaggttacctaaacgggttaaccttaaaaggtttaaacttaaaacgtttaaacggggttacggggttaaccggggttaacccggggtttaaccggggaaacccggtaaaacgggggtaaaacccgttaaaaagggggttaaaccggaaaaaaccttaaacccgggtaaaaacggttaaaacccggttgggtaacgggtaaccgttacggaaccgtaaccccttagttcccggttacgtttacctttaacccg

SEQ ID NO: 442959 - DNA, 625 bp, Homo sapiens
  misc_feature: GZ8MTXP02H4XSR.2.7.A07.1.454.CMB.2.raw
  modified_base (197)..(197): a, c, t, g, unknown or other
  modified_base (449)..(449): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactgggagaagtggtgatgacgcagtctccagccaccctgtctgtgtctcgaggggaaancgccaccctctcctgcgagggccagtcagagtatagcagctaacttagcctggtaccagcaagaacctggccaggcctcccgaggtcctcctcatctatgctcgcactcccgaaccgagggccctagtcggtaactcccgagtcctaggttcaggttcggacgtaggtcggggtactgggggactaggtacgttcaagtttccaccaccctatcgacgtccacgtcccgtgtactacggtactaggtaattntttagacttaattttactacgtgtacgagtactaagttaaataagttacgtgggttacggtaccgttaccgggaaccgtaaaacggggtaaaccgtaaagggtaaactaaaacgtacgaaaacgtaccgtaggtaccgaacgtacggactaccctagttccgttcgttaccctacg

SEQ ID NO: 442960 - DNA, 649 bp, Homo sapiens
  misc_feature: GZ8MTXP02I0S7W.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcgagggccagtcagagtattagcagctaacttagcctggtaccaggtcaacgaaccgtggaccaggcctacccgaggcctccgtacacttctagtcgctgacctactcccgaccgacgggtaccctacgttacgggtacctccccgaggtaccccgttaaggttcccgaaggttcgggcgttaaggggttcggggttcgtagggggactagggtacgttacctacgtttccaacctacctagtccaacgcgtaacgtccgtgacctagtctaagtaagttactttagtacttaacgtttatacgtgttacgaagtactaagttaataagttacgtagggtcgtaacgtacggacgtaaacggacgtaaaggtaacaaactaacgaaacgtaacgtcggtacggaactcggacctactacgttacgtctttacgttacc

SEQ ID NO: 442961 - DNA, 626 bp, Homo sapiens
  misc_feature: GZ8MTXP02HH8WU.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagcccaccctgtctgtgtctccgaaggggaaagacgcccaccctctcctgcgagggccagtcaagtagttattagcagactaacgttagcctaggtaccaggcaacgaaacccgtggacccacggccctcccgaggccctcctacatctatcgctcgcactacccacgacggccctagtcggacctcccgagtcctaggttacagtcggctaggttcggggactgggggaactaggtacgtttcctactttcacctaaaccgatcgagcacggtccagctagtctaaggaagttatttagaaactttatttaacgtacgtttgactagtataagttaactaagttaacggtggttaacgtaccggtacggaaaccggtaaaacgggaactaaaggtaaacaaaagtaacgaaaacgtacggttgacgaacgtagaaccctcaattcttacgttactacc

SEQ ID NO: 442962 - DNA, 615 bp, Homo sapiens
  misc_feature: GZ8MTXP02G8KOJ.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngcccacctctcctgcagggccagtcagagtattagcagcaacttagcctggtaccagcaagaacctggccacggcctcccgaggcctcctcatctatgctgccactcccgaccgacgggcccacgttcggtactaccccgagcccgtagggttccaaggttggccgtagggttcggggtcgtgggggacctaggtacgtttcacttctacgacctatcgagcacggtccctgaccagttctaggtaagttattttagactttaaagtttacttactgtacagtctaaagttataattacgtgggtacgtaacgttcgggaacctaacggggtaaccaaagggtaactaaaacgtacgaaaaccggtaaagtcggttaggccgttacgaacctactaacgttctacgtttacttaccg

SEQ ID NO: 442963 - DNA, 670 bp, Homo sapiens
  misc_feature: GZ8MTXP02IDCZJ.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaaanacgccaccctctcctgcgagggccagtcagagtatagcagcaacttagcccttaggtaccaggcaacgaaccgtggacccagggccctaccccgaggcccttcccgtacattcctatcgcctgaccacttccccgaaccgacggggccctacgtcggtaacctccccgaggtccgtacgggttccaaggttcggaccgtaggggttcggggtaccgtgggggacctaaggtacgtttaccagtttcccgactaccctaactccgaaggtccacggtccctaggctaacgttcgtaaggtaaacgtttatttaccgaatttaaactttttaagtaccttggttaccaggtacttaagtaaattaatacggttggttacggtacgttacgggaacccggaaagggtaaccgtaaaggtaaacaaaacgttacgaaaacgacgtgacggaatcgacaccgtattccgtacttctacg

SEQ ID NO: 442964 - DNA, 768 bp, Homo sapiens
  misc_feature: GZ8MTXP02JHNF0.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccacctctcctgcgagggccagtcagagtatagcagctaacttgccgtaggtaccagacaagaaacctcggaccacggcctacccgaggcctcctcctaatctagtcgtctcgcctactcccgaccggacggggtccctacgtcggtaacctccccgacggtacccgtacggggtttccaagggttcggaccggtagggttcggggttcggtacgggggtactacgggtacggtttcctaagtttccctacccgaacctagtcccgacgtaccgtaccggtccctaacgtcgtacgttaccggtaaggttaaacgttacgtttttacggtaacctttaaagtttttaccgtttacgttacgtttaccgtaggtaaccttaaagggtttaaattaaacgttaacgggtttacgggttaacgggttaaccgggtttaccgggaacccggtaaaacggggtaccggtaaaaggttaaaccggaaacgtttaaaccggaaaacggttaaacggtcggttaacgggaacctacggtaacccttaccgtagtaccggtttactttactttacccg

SEQ ID NO: 442965 - DNA, 567 bp, Homo sapiens
  misc_feature: GZ8MTXP02FI5VQ.2.7.A07.1.454.CMB.2.raw
  modified_base (196)..(196): a, c, t, g, unknown or other
  modified_base (286)..(286): a, c, t, g, unknown or other
  modified_base (325)..(325): a, c, t, g, unknown or other
  modified_base (388)..(388): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggcctcccaggcctcctnatctatcgctgcactcccaccgagggcccagtggtaacncccgagcctaaggttccaggtggactagggtcggggtctgggggacaggtacgtttcatttcncacctatcagcacgcctgcagtctagtaagttatttgacttaatttagttactgttcaagtctaagtaactaaagttacgtgggtacggtacggttacgacgtaaaacggggacctaaaggtaacaaacttaacgaaaacgtacgtggtacgcgtacgactaccagttctcgtctttac

SEQ ID NO: 442966 - DNA, 637 bp, Homo sapiens
  misc_feature: GZ8MTXP02JJ9WH.2.7.A07.1.454.CMB.2.raw
  modified_base (195)..(195): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccgaggggaanacgcccaccctctcctgcgagggccagtcagagtatagcagctaactgcctggtaacccagacaacgaaccgtcggaccacgggcctcccgaggtcctcctacattctagtcgctgacctactcccgaaccgagggccctaacggttccggtactccccgaggtccctacgggttacgaggtcgcgtaggtcgggtctgggggactaggtcgttacacgtttccactaccctataccacggctacgtccgttgacgtacgtacgtaggttaattactttacgtaactttaatttagtaccgttgtacaaggttactaagttaataagttacggtggtacgggtacgtacggaacgtaaaacggggactaaagggaaactaaaacgtacgaaacgtacgtggacgtaacgtacggacctacgacgtttctacgtcctttaacg

SEQ ID NO: 442967 - DNA, 769 bp, Homo sapiens
  misc_feature: GZ8MTXP02H8KXW.2.7.A07.1.454.CMB.2.raw
  modified_base (325)..(325): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgccaccctctcctgcagggccagtcagagtatagcagacaacttagcctaggtacccagcaacgaaaccctggaccaggccctacccgaggcctcctcatcctatcgctcgacactcccaaccgnggggaccctacgtggtacctaccccgaggccctaacggggtttccaagggttcgggaacgtgggttcgggggttcgacgggggtaaccaaggttacggtttaccctaagttttccctacccaaaccctaacgttacccaagggttacccaaacggccccgttagacgtaacggtttaccgttacgggaaaaacgttttcgtttttaaggaaccgtttaaattttttaacgttacgtttacggttaccgaggttaacctaaaggtttaaacttaaaataaccgggtttaggggttacggtaaccggggtttaccgaaaccggaaaacggggtaaccgtaaaacggggttaaaagaaaacgtacccgtaaaaaaccgtaggttaacggttacgggaaccggttacaaccggttacctaaacggtttcgtacgttttaacttacccg

SEQ ID NO: 442968 - DNA, 599 bp, Homo sapiens
  misc_feature: GZ8MTXP02IV1U0.2.7.A07.1.454.CMB.2.raw
  modified_base (354)..(354): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtattagcagcaacttagcctggtaccagacagaacctgccaggcctccaggctcctcatctatgctgcatccaccgagggccacgtggtactccccagccctaggttccagtcggctaggtggggtcngggggacaggtagttcattccacaccatcagcagcctgactagtctagtaagtagtttgacttaatttattacttgtactagtactaagttattaaagtaacgtgggttacggtaccggttacggacccgtaaacggggtaccgtaaaagggtaacgtaaaacgtaccgaaaaacggtaaccttagggtaacggtaaccgttacggaaccgtaaccctagttaccgttacgttacccgtttaccg

SEQ ID NO: 442969 - DNA, 573 bp, Homo sapiens
  misc_feature: GZ8MTXP02IS2X0.2.7.A07.1.454.CMB.2.raw
  modified_base (283)..(283): a, c, t, g, unknown or other
  modified_base (426)..(426): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaagagccaccctctcctgccagggccagtcagagtattagcagcaacttagcctggtaccagcagaacctggccaggctcccgaggctccncatctatgctgcatccaccgagggccagtcggtactccccagcctaggttccagtggctaggtgggtctgggggacaaggtcgtttccagttcctcgacctatcagcacgcctgctagtctagaagtatttgactaaattttntacgtgttacagtactaagttataaagttacgtagggttaggtaacggttccggaccgtaaaagggggacctaaagggtaacgtaaaagtaccaaaacggaaacgttggtacggtaaccgtagaccaactatcgttacggtctttcg

SEQ ID NO: 442970 - DNA, 601 bp, Homo sapiens
  misc_feature: GZ8MTXP02IGZV7.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctcctgcagggccagtcagagtatagcagcaacttagcctggtaccagcaagaacctggccaggctcccgaggctcctcattctatgctgccactcccaccgacgggccaacgttggtaacctccccgagtcccgtaggtttccaggtcggacgtagggttcggggtccgtagggggacctaggttacgtttacactttccacctaacctaatccaaggccacgtcccgtgacgtacgttcgtaagtaaagttattttagaatttaaattttacttaacgtgtacaggtactaagttataatacggtggtcggtacgtacggaccgtaaagggactaaaggtaacgaaactacgaaaacgtacgtgtgaacgtacgacactatcgtctactttacc

SEQ ID NO: 442971 - DNA, 608 bp, Homo sapiens
  misc_feature: GZ8MTXP02GEWG2.2.7.A07.1.454.CMB.2.raw
  modified_base (197)..(197): a, c, t, g, unknown or other
  modified_base (283)..(283): a, c, t, g, unknown or other
  modified_base (289)..(289): a, c, t, g, unknown or other
  modified_base (295)..(295): a, c, t, g, unknown or other
  modified_base (411)..(411): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcaagaacctggccaggctccaggctcctnatctancgccgnactccaccgagggcccacgtggtactcccgagcctaggttccagtggctaggtgggtctggggacaggtacgttcattcctacacctatcagcacgtcctgctagtctaggaattntttagacttaaattttagttactggtcagtactaagttaataaattaacggtgggttacggaccggttacgggaccgtaaaaggggaaacctaaaagggtaaaacgtaaaacgtaaaccgtaaaaacgtaacgttacggtacggggtacctaaggaccctaaacgtacttaccgtttcgttacctttacgtaacccg

SEQ ID NO: 442972 - DNA, 788 bp, Homo sapiens
  misc_feature: GZ8MTXP02GZ63H.2.7.A07.1.454.CMB.2.raw
  modified_base (290)..(290): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagcccaccctctcctgcagggccagtcagagtattagcagcaacttagcctggtaccagcagaaacctggaccaggcctcccgaggcctcctanatctatcgctgcctactcccaaccgtacgggccctacgttcggtacctccccgagtcccgtaagggtttccaaggtcggacgtaggggttcggggtccgtgggggactagggtacgtttaccacgtttccacctaacccgtattaccgaaacggtccaacggtcccttacgggaccgtaaggttcctaagggttaaaaggttactttttaacggtaaacctttaaattttttaaacgtttaccgtttacggttaacccgtaggttaaacccgttaaaggtttaaaactttaaaacggtttaaaccgggttggggttaaccgggttaacccggggtttaaccggggaacccgggtaaaacgggggtaaaccccggtaaaagggggttaaaacgtaaaacggttaaaccggaaaaaccggttaaaccggttggggttaaccggaacggttacggaacccgtaaccgtaactttccggtttaacggtttccgtttaacccg

SEQ ID NO: 442973 - DNA, 561 bp, Homo sapiens
  misc_feature: GZ8MTXP02IUIST.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgcagggccagtcagagtattagcagcaacttgcctggtaccagcagaacctgccaggctcccaggctctcatctatgctgcatcccaaccgagggccctacgtggtactccccgagcctaagggttcaggtggcgaggtgggtctggggaacaggtacgttcatttccacaacccatccaagcacgccctgactagtctagaagtattttgacttaaattttagtactgtacaggtactaaagtataaacttaacgtgggtacggtacgttcggaaccgaaaagggaccaaaggtacgaaaactcgaaaacgtaactgtacggctacgactaccattctacgtcttacc

SEQ ID NO: 442974 - DNA, 602 bp, Homo sapiens
  misc_feature: GZ8MTXP02FH9TT.2.7.A07.1.454.CMB.2.raw
  modified_base (389)..(389): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaaacctggccaggcctcccaggcctcctcatctatcgctgccactcccaccgacgggcccacgtggtaactcccgagtccaaggtttcacggtggcgtaggtcggggtctggggacaggtagttcattcncactatcagcacgcctgcagtctagtaacgttatttgaacttaatttacgttactgtactagactaagttaacgttaaatacgtgggtacggtaccggttcggaaccgtaaaacgggggaacctaaagggtaaagaaaacgtaaccgaaaaacggtaacctgggttagaaccgttacggaacctaccgtattaccgtacgttacctttaaccg

SEQ ID NO: 442975 - DNA, 648 bp, Homo sapiens
  misc_feature: GZ8MTXP02HY5V1.2.7.A07.1.454.CMB.2.raw
  modified_base (199)..(199): a, c, t, g, unknown or other
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaaggggaaanacgcccaccctctcctgcagggccagtcagagtatagcagcaacttagcctggaccagcaagaacctggccaggcctccgaggctccnatctatgctgaccactcccgacccgtagggccctaagtcggtactccccgagccctagggtttcaggtcggacgtagggttcggggtactgggggaacctaggggtaactttcctaagtttcccaactacccacgtaccaggaccacggccctggacctaggtctaagtaagtttacgtttagactttaaattttactacgttgtactaaggtactaagttaaataaacgtttaacggtgggttacgggtaccgtttaccgggaaaccggtaaagggaaaacccgttaaagggtaaacgaaaacgttaccgaaaaacggtacgtaggtacggctacgaacacctatccgttagttacttac

SEQ ID NO: 442976 - DNA, 600 bp, Homo sapiens
  misc_feature: GZ8MTXP02H0PWO.2.7.A07.1.454.CMB.2.raw
  modified_base (196)..(196): a, c, t, g, unknown or other
  modified_base (253)..(253): a, c, t, g, unknown or other
  modified_base (415)..(415): a, c, t, g, unknown or other
  modified_base (510)..(510): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctcgaaggggaaancgcccaccctctctgccgagggccagtcagagtatgcagcaacttgcctaggtaccngaaacacgaaacctggaccaggcctaccgaggtcctcctacatctatcgctgccactcccgaaccgacgggcctacgtcggtacctccccgaggtccctagggttccgaggtcggacgtagggtcggggtctagggggactaggtacgttcattcgacactntcagcgactccgtgtacacgttcgtagtaaagttctttagtaactttaagtttacttacgttgtaccgtaaggtactaagttaactaagttacgnggttacgtacgtacgacgtaaaggactaaaaggactaaaacgacgaaaacgtacgtggtacgaactcgactacgtatcgttcgtacctac

SEQ ID NO: 442977 - DNA, 766 bp, Homo sapiens
  misc_feature: GZ8MTXP02HKZ8U.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcgacgggccagtcagtagtattagcagactaacttacgccgtacggtaccaggaccgaaacgtaaacccgtcggacccgacgggtaccctaccccgacggtccctaccctacaacttcctaagtcgctacgtaccaacgttccccgaaccgaccggggtaccctaacgttcgggttaacctcccccgaaggtacccgtaacggggtttccagggttcgggacgtaggggttcggggttctgggggaactagggttacgtttctactttccgacacctagtacacgtcgacgcttcggacctaggttcgtaagttaaggttactttacgaactttaaatttttacgttagttcgttaacgtagtacttaaagttaaacgttaacgttaacgggttagggttacgggtaaccgggtttaccgggaaacccgggtaaaacggggtaacccggtaaaagggttaaacgtaaaaccgtaaacgtaaaacggtacgttacggtaacggaaccgttacggaacctaaactcgtttaccgtttacggtttccctttaacccg

SEQ ID NO: 442978 - DNA, 723 bp, Homo sapiens
  misc_feature: GZ8MTXP02IXRV5.2.7.A07.1.454.CMB.2.raw
  modified_base (195)..(195): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaanacgccaccctctcctgcgagggccagtcagagtattagcagctaacttgcctaggtaccagacaacgaacctggaccacggcctcccgaggtcctcctacacttctagtcgctcgaccactcccgaccgacgggccctacgtcgtacctcccgagtccgtacggttcaggtcggacgtagggtcgggtcgtgggggactaggttacgttactactttaccgacctacctacgttacccgacgtacccgacggtcccgttagaccgttacggttacttaagggtaaacgtttagtttttacggtaaacctttaaatttttaacgttaacgtttacgtacgtaacggtacttaaaggtttaaaacttaaacggttaaacgggtttcggggttaacggggttaccgggtttaacccgggaaaccgggttaaaacggggaaccgttaaaaggggtaaaacgtaaacgtaaacgtaaaacggtacgttagggacgtaacgtacgactaccgtattccgttacgttactttacc

SEQ ID NO: 442979 - DNA, 542 bp, Homo sapiens
  misc_feature: GZ8MTXP02FVHO5.2.7.A07.1.454.CMB.2.raw
  modified_base (196)..(196): a, c, t, g, unknown or other
  modified_base (283)..(283): a, c, t, g, unknown or other
  modified_base (315)..(315): a, c, t, g, unknown or other
  modified_base (363)..(363): a, c, t, g, unknown or other
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaacctggccaggctcccaggctcctnatctatgctgcatccacgagggccatggtacnccagccagttcagtgctaggtgggtctggggacaggtagttcatttcncacatcagcagctgcagtctagagtatttgactaatttntactgtacagtctaaagttataaacgttacgtgggtacgtacgttacgggacctaaggggaaccaagggtaacgaaaacgtacgaaaacgtaacgtcggttaggaacctagacctacctagtccttaggttccctttacg

SEQ ID NO: 442980 - DNA, 789 bp, Homo sapiens
  misc_feature: GZ8MTXP02IIGZ3.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggtaccagcagaaacctggaccaggcctcccaggcctcctcatctatcgctcgcatcccaccgacgggcctaacgtggtacctccccagcctacggttccaggtcggacgtagggttcggggtacgtgggggtacctaaggttaacgtttacctaacgtttccctacctaaaccctagtaccaacggtccgacggtccctaggtacctaacgggttccttaaggtaaagggtttactttttcgggaaaccttttaaaaggtttttttacttaaccggttcgttaaccgtacgggttaaaccttaaaggtttaaaatttaaaacgtttaaacgggttacgggggtttaacggtaccccgggttttaacgggggaccccggttaaaaaaacgggggaaaccccggttaaaaagggggttaaaacgtaaaaaacgttaaccccgggtaaaaacggtaaacccggtttgggttaaacgggaacgtttacccgggaaaccctacgggttaaccgtttacctttacggtttaccctttaaacccccg

SEQ ID NO: 442981 - DNA, 675 bp, Homo sapiens
  misc_feature: GZ8MTXP02H9X7I.2.7.A07.1.454.CMB.2.raw
  modified_base (198)..(198): a, c, t, g, unknown or other
  modified_base (251)..(251): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctccagatgccactggagaagtggtgatgacgcagtctccagccaccctgtctgtgtctcgaagggggaaanacgccacctctcctgcagggccagtcagagtatgcagcaacttgcctggaccngcagaacctggccaggctccaggcctcctcatctatgctgcatccccaaccgagggccctagtcggtactccccgagtcctaggttcaggtcggacgtaggtcggggttctgggggactaggtacgtttccaacgtttccacaccgtaacgttccgagtaccgacgtccctacgtccgtaggtttccgtaaggtaaacgtttacgtttttagaaaccttttaaatttttaacgttaaccgtttgttaccgaaagtacgtaaagtttaaactaaagtttaacggtggggttaacggtacgggtttacccgggaaccgtaaacggggtaaacccgtaaaggggtaaacgtaaaacgttaaacgaaaaccggtacgttacgggacgtaacgtcgaaccgtacgtactccgttacgtttacttacccg

SEQ ID NO: 442982 - DNA, 576 bp, Homo sapiens
  misc_feature: GZ8MTXP02FNYF1.2.7.A07.1.454.CMB.2.raw
  modified_base (421)..(421): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctacagggccagtcagagtattagcagcaacttagcctaggtaccagcaagaaacctggccaggcctcccaggctcctcatctatgctgcatccaccgagggcccacgtggtactcccgagcccgtaggttcccaggtcggacgtaggtggggtctaggggacaggagttacagttcctacacctatcagcagctgactagtctagaagttntttagacttaatttattactgtactagactaagttaaacttaagtactgggtagtacggttacggacgaaaagggtaaccgtaaaaggtaagaaaacgtacaaaaccggagttacggcgtacgtgaccacctagtcctttagtaccttctaaccg

SEQ ID NO: 442983 - DNA, 528 bp, Homo sapiens
  misc_feature: GZ8MTXP02FORYD.2.7.A07.1.454.CMB.2.raw
  modified_base (197)..(197): a, c, t, g, unknown or other
  modified_base (317)..(317): a, c, t, g, unknown or other
  modified_base (517)..(517): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaattagcctggtaccagcagaaacctggccaggcctccaggctcctcatctatgctgcatccaccagggccagtcggtacncccagcctaggttccagtggctaggtcgggtctggggacaggtagttcatttcacaaccatcagcagcctagcagtctaggaatattttgacttaaatttatactgtacagtactaagtaataataacgtggtacggtacgttcgacgtaaagggacctaaaggtacaaatacgaaaacgactgtagctacgactaactntctacgtctac

SEQ ID NO: 442984 - DNA, 771 bp, Homo sapiens
  misc_feature: GZ8MTXP02GGG7T.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagagccaccctctcctgcagggccagtcagagtattagcagcaacttagcctggtacccagcaagaaacctggccaggcctcccgaggcctcctcatctatgctgcactcccaaccgagggccctacgtggtactcccagcctaggttccaggtcggacgtaggttcggggtctgggggacctaagggtacgttaccatttacctccgaaaccctattccgaaacggtcccaacgggtccccttagggaccctaaggtttccttaagggtaaaaccggttattttttcgggaaacctttaaaatttttactttaaacgtcggtttaaccagggttaacctaagtttaaaagttaaaacgtttaaaccggttagggggttaccgggttaaaccgggttttacgggggaaaaccccgttaaaaagggggtaaccccgtaaaaagggggttaaacgtaaaaaaaccgtacccggtaaaaaaaccgggttaaaaccgttggggtttaaaccggggaacctttaacggaacccgtaaaaccccttaaggtttccctttaaacggtttccccttttaaccg

SEQ ID NO: 442985 - DNA, 573 bp, Homo sapiens
  misc_feature: GZ8MTXP02FPE1A.2.7.A07.1.454.CMB.2.raw
  modified_base (196)..(196): a, c, t, g, unknown or other
  modified_base (361)..(361): a, c, t, g, unknown or other
  modified_base (400)..(400): a, c, t, g, unknown or other
  modified_base (415)..(415): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacctggccaggcctcccgggctcctcatctatgctgcactccaccgagggcccactggtactccccagccctaggttccaggtggcaggtgggtctggggacngagttcattctacacatcagcagcctgcagtctgaagtntttagcttaaatttntactgtacagtactaagttaataagttaacgtgggttaggtacggttacgggaccgtaaacggggaacctaaagggtaaagaaaactaccgtaaaaacggaacgttaggtaggtaccgtaacggacctaaacctagttccttacgtaccttctaaccg

SEQ ID NO: 442986 - DNA, 633 bp, Homo sapiens
  misc_feature: GZ8MTXP02IHXNN.2.7.A07.1.454.CMB.2.raw
  modified_base (196)..(196): a, c, t, g, unknown or other
  modified_base (206)..(206): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccacctcncctgcagggccagtcagagtattagcagcaacttagcctggtaccagcaagaaacctggccaggcctcccaggcctcctcatctatcgactgcactcccgaccacgggccacgtcggtactccccagtcctaggttccaggtcgcgtaggtcggggtctgggggactaggtacgttccagttctcaacctatcgacgtacacggccctgctacgtatagtaagtatttgactttaaatttattaccgttgtactaaggtactaaggttaattaaacgtaacgttagggtacggtaccggtttaccggaacccgtaaaacggggtaacccgtaaaagggtaaacgtaaaaacgttaaaccgaaaacggtaaacgttggtacgggtaacttaacggaccaccgtaattaccggtttcgtacctttaccg

SEQ ID NO: 442987 - DNA, 664 bp, Homo sapiens
  misc_feature: GZ8MTXP02JHSZ0.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcgagggccagtcagagttatagcagctaacttgcctaggtaccagcaagaacctggccaggcctcccgaggcctccactatctatcgtctgacctactcccaaccgacggggcctacgttcggtaacctccccgaagtccacgggtttccaggtcggacgtagggtcggggtactgggggactagggtacgtttccagtttccaccacctaagtccaaggtcacgtcctgaccgtagtccgttagtaagttagtttacgaactttaaattttacgttacgttagtactacgtataaagttaataaacgtacggttggtaccgggtacgttacggaacgtaaaacggggtactaaaagggtaacgtaaaacgtaaacgtaaaacgtaacccggttggtaccgtaacgttaacggaccctaacgttacttaccgtttccggttactttaacccg

SEQ ID NO: 442988 - DNA, 669 bp, Homo sapiens
  misc_feature: GZ8MTXP02GUMOW.2.7.A07.1.454.CMB.2.raw
  modified_base (197)..(197): a, c, t, g, unknown or other
  modified_base (437)..(437): a, c, t, g, unknown or other
  modified_base (499)..(499): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagccgtagaccagacaacgtaaccgcggaccgacggccctacccgacggtccctacctactacttactagtcgtcgtcaccacctacccgaacgacgggaccctacggtgtacctccgacgtacgtacgttacgaggtgacgtaggtcggttcgtgggacaggttacgtactcttactacaacctacgcacgacncgtccagtaaccgtgtacgtaagttaatttacgttataacctttaaattttacttacggttntaacgtagtaactaaagttaacgtaacggttacgggttaggttaccggtaccggtaacgggaaaaccggtaaacggtaaaacgtaaaaggtaaaacaaaccgtaaacggtaaaccgtagtacggtacgtaacgacgtaacctaacgttacttcgttaccgtttactaccg

SEQ ID NO: 442989 - DNA, 574 bp, Homo sapiens
  misc_feature: GZ8MTXP02FO7AN.2.7.A07.1.454.CMB.2.raw
  modified_base (290)..(290): a, c, t, g, unknown or other
  modified_base (387)..(387): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctaggtaccagcaagaaacctggccaggcctcccgaggcctcctnatctatcgctgccactcccgaccagggccctacgtggtactcccagtccaggttcagtggctaggtcgggtctgggggactaggtagttcatttccncactatcagcagctgcagtctagagttactttgacttaatttattactgtcagtctaaagttataaagtaacgtggtagtacgttcggaccgtaaagggtaaccgtaaagggtaacgtaaaacgtacgtaaaaacgtaccgtggtacggaactacggacaacctagttcctacgttacctttaaccg

SEQ ID NO: 442990 - DNA, 733 bp, Homo sapiens
  misc_feature: GZ8MTXP02IKN3O.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagcccagcgcagcttctcttcctcctgctactctggctcccagatgccactggagaagtggtgatgacgcagtctccagccaccctgtctgtgtctccagggggaaanagccaccctctcctgcagggccagtcagagtattagcagcaattagcctggtaccagcaagaaccgtggccaggcctcccgaggctcctcatctatgctcgcatcccaccgacggggcccaactcggtaactccccaacggccgtacgggttacaggtcggctaggttcggggtctggggggaacacgggtagtttcctaactttccgtacctaacccgtaacttacgacgtaccgaacggtacccgtcggtacgtacggttacccgttaaggtaaaacggttatttttacggtaaccgtttaaaagttttttaaactttaaacgttccgggtttaataacggttaacctaaggttaaagtttaaaacctttaaaggtttacggggttaggggtttaaacccggtttacggggaaacccgttaaaacgggggaacccggtaaaaggggtaaacggtaaaaaactaccggtaaaaccgtaaaacgttggtaacggtaacgtacgaactaaccgttactacgtttacggtctttaaccg

SEQ ID NO: 442991 - DNA, 643 bp, Homo sapiens
  misc_feature: GZ8MTXP02F2ISQ.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgccaccctctcctgcagggccagtcagagtattagcagcaacttagcctggtaccagcaagaaacctggccaggctcccaggcctctcatctatcgctgcactcccaaccgagggcccacgtcggtactcccgagcctaagggttccaggtcggacctagggttcgggtccgtggggacctagggtacgtttccaatttccacaccctaatccgagtccacgtccctaggccctagttacgtagtaaagtacgtttttacgacctttaaatttttacttacgtagttacgacgtactaaaggttaattaaacgtaacgttcgggtacggtaaccgggttacggaacccggtaaaaggggtaaccgaaagggttaaaacgaaaacttacgaaaacgtaaacgtggtacggaactacgacctaactacgttctacgttccttaaccg

SEQ ID NO: 442992 - DNA, 667 bp, Homo sapiens
  misc_feature: GZ8MTXP02G3GMI.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttgcctggtaccagcagaaacctggccaggcctcccaggctcctcatctatgctgcactcccacgacgggcctacgtcggtactcccgagcctacggttcaggtggcgtagggttcggggtctgggggacctaggggtactttccgatttccacaaccctatccgaacgtccgacgtcccgtgacctaacggtcgttaaggtaaagttagttttacgaaacctttaaattttaacttaccgttaggtacctagggtactaaagtttaaacgtaaacgttaacgttggggtaacggttaccggttacgggaacccgtaaaaggggtaaccctaaaaggggttaaacgtaaaagtaacccgtaaaaacggtacgttacggttacggaacttaccgaacctacccgtattcggtttacgttcctttaaccc

SEQ ID NO: 442993 - DNA, 808 bp, Homo sapiens
  misc_feature: GZ8MTXP02JP1HD.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctaccgaaggggaaagacgcccaccctctcctgcagggccagtcagagtattagcagcaacttagcctggtaccagacaagaaccgtcggacccaggcctacccgacggcctccgtcatctatcgctgaccactccccaaccgacgggccctaacgtggtacctccccgaaggcccctaagggttccagggtcggacgtaggggttcggggtacgtgggggaactacgggtaacggtttcctaacgtttccctaaccaaccctaacttacccgaacggtaccgacggtaccccgttcggaccgtaacgggttaccgttaagggtaaacggtttactttttaacggtaaaccttttaaaagtttttaaacgtttaaccggttaacgttacgtaaacgggtaaccttaaaaggtttaaacgtttaaaacgtaaaccggtttagggggttaaccggggttaacccgggtttaaccgggggaaacccggtaaaaacgggggtaaacccggtaaaaagggggtaaaacgtaaaaaccgttaccggtaaaaaccggtaacggttacgggtacggtaaccgtaacgtaacccgtaaaccttacgttaccgttaccggtttacctttaacccg

SEQ ID NO: 442994 - DNA, 625 bp, Homo sapiens
  misc_feature: GZ8MTXP02H4PU6.2.7.A07.1.454.CMB.2.raw
  modified_base (198)..(198): a, c, t, g, unknown or other
  modified_base (468)..(468): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgcccaccctctcctgcgagggccagtcagagtatagcagacaactagcctggaccagcaagaaacctggacccaggcctacccgaggcctcctcatcctatcgctgccactacccgaaccgagggacccctagttcggtaacctaccccgagtccccgtaaggggttccaagggttcggacgtagggttcggggttctggggaactaggtacgtttacacgtttccacacccataccgagccagccctgactagtctagaaacgtttnttacgatttaatttacgtacgtagtacagtataagttaataacgtacggtggtacggtaccgtacgaacgtaacgggaactaaaggtaaactaaacgtacgtaaaacgtacgttagacgtaacgtacgtaacctacgtacttcgttacttactaccg

SEQ ID NO: 442995 - DNA, 618 bp, Homo sapiens
  misc_feature: GZ8MTXP02HY3HJ.2.7.A07.1.454.CMB.2.raw
  modified_base (198)..(198): a, c, t, g, unknown or other
  modified_base (273)..(273): a, c, t, g, unknown or other
  modified_base (373)..(373): a, c, t, g, unknown or other
  modified_base (438)..(438): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanagccaccctctcctgcagggccagtcagagtatagcagcaacttagcctggaccagcaagaaacctgccaggccnccagcctctcatctatcgctgcactccaaccgagggccctaacgtcggtaactccccgagccctaagggttccaaggttcggacgtagggtcggggttcngggggaactaggtacgttcattccacacccgaatcgaagcacggcctgctagtctaggaaatttnttacgaatttaaattttatacttgactagtacttaaagtaaactaaacgttaaggtggtacggtaaccggtacggaaaccggtaaaacggtaaaccgtaaaaggtaaaactaaaacgtaaacgaaaaacgtacgttggacgtaactacgaacctacgtactttccgtacgtttacctacg

SEQ ID NO: 442996 - DNA, 514 bp, Homo sapiens
  misc_feature: GZ8MTXP02JV2W7.2.7.A07.1.454.CMB.2.raw
  modified_base (196)..(196): a, c, t, g, unknown or other
  modified_base (471)..(471): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctccaggctcctcatctatgctgcatccaccagggccacgtggtactccccagccaggttcagtggcaggtgggtctggggacaggtacgttcagttctacaccatcagcagcctgcagtctagtaagttatttgacttaatttatactgtcagtcaagttaataatacgtggtgtacgttcgacctaagggacaaaggtanaaatacaaaacgactgtacgcgtacgacacgatctcgtcttac

SEQ ID NO: 442997 - DNA, 664 bp, Homo sapiens
  misc_feature: GZ8MTXP02IWLVE.2.7.A07.1.454.CMB.2.raw
  modified_base (194)..(194): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgagggaanagccacctctcctgcagggccagtcagagtattagcagcaacttagcctaggtaccagacaacgaacctggaccacggcctacccgaggcctccctcatctatgctgcactccaccgacgggcctacgtcggtactcccagccgtaggttcagttcggcgtaggttcggggtcgtgggggaactaggtagttcctagttcctacctaaccctataccgacgtaccgacgtacccgtggtactacggttacgtagggttaaacgttagttttacggtaacctttaaagtttttacttaacgttcgttaccgaagtaccgtaaagttaattaaagttacggttagggttacggtaacggttacggaaccggtaaaacggggactaaaagggtaacgtaaaacgtaacggaaaacgtaacgttcggtagggaacttacggaccctaactacttccgttacgttacctttaccg

SEQ ID NO: 442998 - DNA, 550 bp, Homo sapiens
  misc_feature: GZ8MTXP02I8MW4.2.7.A07.1.454.CMB.2.raw
  modified_base (375)..(375): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcagggccagtcagagtattagcagcaacttagcctggtaccagcaagaacctggccaggctcccaggctcctcatctatgctgcatccacgacgggccacgtaggtactccccgagccaggttccagtggcaggtgggtctggggacaggtacgttcatttcncaaccatcagcacgctgacagttcagtaagtatttagacttaatttattactgtacagtctaagtactaaataacgtggtacgtacgttcgacgtaaacgggactaaaaggggtacaaaactacgaaaacgtaacgtgtaggaacctcggacctactattcgttcgtactttacg

SEQ ID NO: 442999 - DNA, 654 bp, Homo sapiens
  misc_feature: GZ8MTXP02IC4X3.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanagccaccctctctgcagggccagtcagagtattagcagcaacttagcctaggtaccagacaagaacctggccaggctcccacggctcctcatctatgctgacactcccaccgacgggccacgtcggtactcccagtccgacggttcaggtggcgtaggttcgggtcgtgggggacaggtacgtttcacgttctacgacctactcacgacacgccctgacacggttactaggtaaagttacttttaggtaactttaaatttttacgtttaccgttagttacgtaagtaccgttaagttaaacttaaagtttaaaccgttggggtacggttacgggttacccgggaacggtaaaacggggtaacccgtaaaagggttaaacggtaaaaacgttacgtaaaaaccggtaacgttacggtacggaacgtacggtaccacgtactacgttcgttactttaccg

SEQ ID NO: 443000 - DNA, 758 bp, Homo sapiens
  misc_feature: GZ8MTXP02I1QID.2.7.A07.1.454.CMB.2.raw
  modified_base (195)..(195): a, c, t, g, unknown or other
  modified_base (297)..(297): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccgaggggaancgccaccctctcctgcagggccagtcagagtatagcagactaacttagcctggtaccagcaagaacctggccaggcctacccgaggcctcctcattctatcnctgacactcccaccgagggccacgtcggtactccccgagccgtaggttcaggtgacgtaggtcggggttactgggggactagggtacgtttacgacgtttcctaccgaaccctaacgtcccgaacgcctaacggcccgttggactacggttacgtaagggtaaactttagttttacgtaaccgtttaaatttttaacgtttacgttacggttaaccaaggttaccgtaaaaggtttaaactttaaaacgttaaacgggttacgggggtttacggggttaacccggggtttaaacgggggaaccccggtaaaaacgggggtaaacccgtaaaaagggggttaaaacggtaaaaaccgttaaaaccggtaaaaaccggttaaacggtttacgggtaacggtaacccgtaacggtaacccggtaaccgttaactttaccggtttacgtttacccgtttaacccg

SEQ ID NO: 443001 - DNA, 589 bp, Homo sapiens
  misc_feature: GZ8MTXP02GQJA6.2.7.A07.1.454.CMB.2.raw
  modified_base (197)..(197): a, c, t, g, unknown or other
  modified_base (281)..(281): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccacctctcctgcagggccagtcagagtatagcagcaacttgcctggtaccagcagaaacctggccaggctccaggcctccncatctatgctgcatcccaccgacgggccacgtcggtactcccgagcctaacggttcaggtggcgtagggtcggggtctggggacctagtagttcagtttccacaccatccagcacgccctgcagtctagtaagttatttgaacttaaatttattacttgtacagtactaagttaattaagtaacgtgggtacggtacgttacggacgtaaacggggtaccaaagggtaacgtaaaacgtaccgaaaacggtacgttaggtacggtaacgttcggaaccaaccgtacttacgtacgtttacctttaccg

SEQ ID NO: 443002 - DNA, 566 bp, Homo sapiens
  misc_feature: GZ8MTXP02GETOF.2.7.A07.1.454.CMB.2.raw
  modified_base (386)..(386): a, c, t, g, unknown or other
  modified_base (420)..(420): a, c, t, g, unknown or other
  modified_base (436)..(436): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctaggtaccagcaagaaacctggccaggcctcccgaggcctcctcatctatcgctgcatcccaacacgggccagtcggtactcccgagcccgaggttcaggtggacgtaggtcgggtctgggggactaggtagttcattcncactatcagcagccttgacctagtctagaacttntttgaacttaaatttntaacgttgtacagtctaaagtataataacgtggtacggtacgttacggacgtaaaacgggactaaagggtaacaaaagttaacaaaacgtaactggtacgcgtacgacctacattctacgtacttaaccg

SEQ ID NO: 443003 - DNA, 542 bp, Homo sapiens
  misc_feature: GZ8MTXP02JLFSG.2.7.A07.1.454.CMB.2.raw
  modified_base (198)..(198): a, c, t, g, unknown or other
  modified_base (320)..(320): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaanagcccaccctctcctgcagggccagtcagagtattagcagcaacttagcctggtaccagcaagaacctggccaggctcccaggcctcctcatctatgctgcatcccacagggccagtgtacnccagcctaggttcagtgcaggtcgggtctggggacaggtcgtttcagttcacacctatcagcagcctgactgtctagtaagtatttgacttaatttatacttgtacaagtactaagttaaactagtacgtggtagtacgttcgaacgtaaacgggactaaggtaaacaaagttacaaaacgtacgtggtacggaactacgacactagtacttacgtacttac

SEQ ID NO: 443004 - DNA, 865 bp, Homo sapiens
  misc_feature: GZ8MTXP02F6XA4.2.7.A07.1.454.CMB.2.raw
  modified_base (384)..(384): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctaccgagggggaaagacgcccaccctctcccgtgacgacgggaccagtcgaagtagttatacgacagactaacgttcgcgtacggtaacagaccaaacgtaaaccgtcggaccgtacggccctacccgaggtccctcctatatacctgtcgtcgtcgacctacctacccgaaccggaccgggacctacggtcggttaaccncccgacggtaccgtacggttaccgagggtacgtacggttaggggttccggttacgggtacgggggactaaacgggttacggtttaacccttacgttttacccgtaaacccaaaccgttacgtacccgtaacggtacccgaaccgttaccggttcgaaaccgttccgggtttactaaaggggttaaacttttagttacggttaaaaccttttaaatttttaccgttaacccgttagtaacccgtaacgggtaactttaaaaagttaaaccgttaaaaaggttcccggggttagggggttaaaccccggttaaccgggggttaacccggaaaacccggggtttaaaaggggaaaccccgttaaaaaagggggttaaaccaaaaaaccgtttaaaacgggaaaaacccgttaaccgtggggttaaccgggaacttaccggaaaccctaacggttctttaccgtacggttttaacccttaacccg

SEQ ID NO: 443005 - DNA, 616 bp, Homo sapiens
  misc_feature: GZ8MTXP02FXX9J.2.7.A07.1.454.CMB.2.raw
  modified_base (197)..(197): a, c, t, g, unknown or other
  modified_base (291)..(291): a, c, t, g, unknown or other
  modified_base (426)..(426): a, c, t, g, unknown or other
  modified_base (575)..(575): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctcgaggggaaancgccaccctctcctgcagggccagtcagagtatagcagccaattacgcctggtaccagacaagaaacctggccaggcctacccgaggcctcctnactctagtcgactgaccactccgaccgacgggtcccaacgtcggtacctcccgacggtaccctagggtttccagggttcgggcctagggttcggggtctaggggacctaggtagttaccatttccaccactactnaagcaggcctgacagttctagtaagtactttgaacttaaatttcctaatgtacctaaggtactaagttaaattaacgaggtttagggtcgtaacgtaccggacggtaaaacggacgaaaagggttaacaaaacgaacgaaacgtaacgnggttacggaactacgaccaccgttatcttacgtactttccg

SEQ ID NO: 443006 - DNA, 557 bp, Homo sapiens
  misc_feature: GZ8MTXP02HBYI4.2.7.A07.1.454.CMB.2.raw
  modified_base (199)..(199): a, c, t, g, unknown or other
  modified_base (378)..(378): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgagggggaaanacgccaccctctcctgcagggccagtcagagtattagcagcaacttagcctggtaccagcaagaaacctggaccaggctccaggctcctcatctatgctgcactcccaacgagggccacgtggtaactcccagtccaggttcaggtggactaggtgggctggggacagtagttcattcncacatcagcagctgcagctagaagtatttagactaaattttataaacgttgtacagtactaagtaataattaacgtgggtagtacgtttacggacgtaaacgggaaccgaaaggttaaacgaaaagtaccgtaaaacgaacgtaggtaggaactcggaaccacactcgtacgtacttac

SEQ ID NO: 443007 - DNA, 613 bp, Homo sapiens
  misc_feature: GZ8MTXP02JQ0Z1.2.7.A07.1.454.CMB.2.raw
  modified_base (308)..(308): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctccgaggggaaagacgccaccctctcctgcagggccagtcagagtatagcagcaacttagcctggtaccagcagaacctggccaggcctcccgaggctcctcatctatgctgcatcccgaccncgggccagtcggtactccagctaggttcagtcgcgtaggtgggtctggggacaggtacgtttcactttccgactaccatcagccacggtcctgactacggtctaggtaagttattttggaaacttaattttaacttacgtcgttacaggtactaaagttaataaacgttaacgtgggtacggtaacggggttccggaacccggtaaagggggtacccaaagggtaaacgtaaactaaaccggtaaaaccgtacggtagtacggaaccgttacgaccgtaccctagttcctacgttacctttaccg

SEQ ID NO: 443008 - DNA, 584 bp, Homo sapiens
  misc_feature: GZ8MTXP02FOLPX.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctccctgctactctggctcccagatgccactggagaagtggtgatgacgcagtctccagccaccctgtctgtgtctccgaggggaaagacgccaccctctcctgcagggccagtcagagtatagcagcaacttagcctggtaccagcagaaacctggccaggcctacccaggcctcctcatctatgctgcactccaccgacgggccacgtggtactcccgagtccaggttcagtggcgaggtgggtctggggacaggtagttctattcacacatcgagcacgtcctgcagttctagtaagttatttgtacttaaagtttattacgtgtactagtactaagtaattaagtaacgttggtacggtacggttcggaaccgtaaagggtaaccgtaaaaggtaacgaaaacgttacgaaaacggtaacgtaggtacgtaacgtacgaccgtacctagtttccgtacgttactttaccg

SEQ ID NO: 443009 - DNA, 820 bp, Homo sapiens
  misc_feature: GZ8MTXP02I3MZ6.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagngccaccctctcctgcagggccagtcagagtattagcagcaacttagcctggtaccagacaagaacctggaccaggcctacccgaggcctccctacattcctagtcgctcgacctactaccccgaccgacggggcccctacggttcggtaacctcccccgaaaggtccccgtagggtttaccgagggttcggacgtacggggttcggggtcgttacggggggacctagggttacggtttacctacgttttaccctaccgaaaccctagttaccgaaacggtcccaacggtcccgttggtacccgtaacggtttccgttaaagggttaaaagtttacgtttttacggtaaaccttttaaaacgttttttactttaaacggtttcgttaacctaacgggttaaccttaaaaggtttaaaatttaaaacgtttaaacgggttacgggggttaccggggttaaaccgggtttacccggggaaaacccggttaaaaacgggggtaaacccggtaaaaagggttaaaacggttaaaaaccgtaaccggtaaaaaaccggtaaacggttcgggtaaacgggtaacctaccggaacttaaccccgtatttaccgttacgtttcctttaaccg

SEQ ID NO: 443010 - DNA, 726 bp, Homo sapiens
  misc_feature: GZ8MTXP02H6LSP.2.7.A07.1.454.CMB.2.raw
  modified_base (200)..(200): a, c, t, g, unknown or other
tcagacgctcgacacacgaccggtgctcgatttagcacgtgtcgcagggggaggaactgctcagttaggacccagacggaaccatggaagccccagcgcagcttctcttccctcctgctactctggcctcccagatgccactggagaagtggtgatgacgcagtctccagccaccctgtctgtgtcctcgaaggggaaancgccaccctctcctgcagggccagtcagagtatagcagcaacttgcctggaccagcagaacctgccaggcctccgagcctctcatctatcgctcgccactccccgaaccgacgggccctacgtcggtacctccccgagtccgtaggttcacggtcggcgtagggttcggggtctgggggaactaggtacgtttacctagtttccacaaccctatccgaaggcctaacgtcccgtaggtacccgtaggttaccgttaaggtaaaacgtttcgtttttaaggaaacctttttaaaatttttttaaccgtttaaccgtttaggttaacccaagggtacctaaaagttaaacttaaaagtttaaccggtggggtttaaccggggtacggtttacccggggaaaacccggtaaaacgggggtaacccgtaaaacggggttaaaaacgtaaaacggtaaaccgtaaaaccgggtacggttacggtacggtaaccgtacgaaccctaccgtatttccgttacgtttaccctcg

SEQ ID NO: 443011 - DNA, 693 bp, Homo sapiens
  misc_feature: GZ8MTXP02I7MK0.2.7.A07.1.454.CMB.2.raw
  modified_base (196)..(196): a, c, t, g, unknown or other
  modified_base (210)..(210): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgcccacctctccngcagggccagtcagagtatagcagcaattagcctggtaccagcaacgaaacctggccaggcctcccgaggcctcctcattctatgctgcctactcccgaccgagggccctaagtcggtactccccgagtcctaggttcaggtcggactaggtcgggtctgggggacctaggtacgttcacgtttcctactaaccgtactaccgaaggtcccgaacggtcccttaggtaccgtacggttacgtaacgggttaaagttacttttaggtaaacctttaaaaggtttttacttaaccggtttagtaccgtaaagttaccgtaaaggtttaaacttaaacgtaacggtttagggtaccgggttaacgggttaccggaaccggtaaaaggggaaccgttaaagggtaaaacgtaaaacgtaaccgtaaaacgtaaacgttggtacggtaactacggtacctaccgtattaccgttacgtacgtttaccg

SEQ ID NO: 443012 - DNA, 712 bp, Homo sapiens
  misc_feature: GZ8MTXP02H3G7S.2.7.A07.1.454.CMB.2.raw
  modified_base (198)..(198): a, c, t, g, unknown or other
  modified_base (292)..(292): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctccagatgccactggagaagtggtgatgacgcagtctccagcccaccctgtctgtgtctccgagggggaanagccacctctcctgcagggccagtcagagtatagcagctaacttagcctggtaccagcaagaacctggccaggctcccaggcctcctcatctangctgacactccgaccgacgggccctacgtggtacctcccgagtccgtagggtttaccaggtcggacgtagggtcggggttaccgtgggggaactaaggtacgtttacctaacgtttccgactaaaccctataccacgtaccaacgtcccttgaccgtacgttacgtaaggtaacgttagtttcgtaactttaaactttttaatttaccgttagttaccgtagtaaccgttaaagttaaagtttaaaacgttaacggttaacggggttagggttaaacccgggtttaccgggtaaacccggtaaaaacggggtaaaccgtaaaacgggtaaacggtaaaaacgtaaaccgaaaaccggttaacgtaggtacggtaacgtacgtaaccctaacgttaacgtccgtttacgttacctttaccg

SEQ ID NO: 443013 - DNA, 514 bp, Homo sapiens
  misc_feature: GZ8MTXP02HNJR3.2.7.A07.1.454.CMB.2.raw
  modified_base (357)..(357): a, c, t, g, unknown or other
  modified_base (390)..(390): a, c, t, g, unknown or other
  modified_base (405)..(405): a, c, t, g, unknown or other
  modified_base (407)..(407): a, c, t, g, unknown or other
  modified_base (409)..(409): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggccactggatccagccagtcagtggcagtggctggggacagagttcaatttcncaccatcagcagcctgcagtctgagatttatanatttattaacttgtnananataataataagtagtaggtacgtacgtacgaacggaacgaaaggtaaagaaagtaacaaaacgaaacgtaagtagtaacgtacgacgacactactacgttacttc

SEQ ID NO: 443014 - DNA, 665 bp, Homo sapiens
  misc_feature: GZ8MTXP02HPTXU.2.7.A07.1.454.CMB.2.raw
  modified_base (402)..(402): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctacgaggggaagacgccacctctcctgcgacgggccagtcagagtatagcagacaacttagccgtaggtaccagacaacggaacccgtggcccacggcctacccgacggtccctaccgtcactctagtcgctcgctactcccgaccgacgggtacccacgtcggtactccccgaagtccgtaacggttccgaggtacggacgtagggttacggggtcgnggggtactaggtacttaccgtatccgtacaccgtatcgagccgacgtccgtagctacggtactaggtaacgtttatttacgtatttaaacgtttttataccgttagtacttaacggtattaaacgttaagttaacggtaacggttaggggttacggtaccgggttaccggaaacggtaacggggtaaaccgtaaggtaaacgaaaacgtacgtaaaacgagtacgtaggaactacgacctacattaccgttctttacgtaccg

SEQ ID NO: 443015 - DNA, 668 bp, Homo sapiens
  misc_feature: GZ8MTXP02GEISH.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagngccaccctctcctgcagggccagtcagagtattagcagcaacttagcctggtaccagcagaaacctggaccaggcctcccgaggcctcctcattctatcggctcgctactcccgaccgaggggccctaacgttcgggaactccccgaaggtccaagggtttccaagtcgggactagggtcggggttactgggggactaggtagtttccagtttccacgaccctagtccaaaggtccaacggtccctggactaacgggttctaagggtaaagttcttttagaccttaaatttttaacttacgttgtacaacgtactaagtttaaactaagttaacggttcgggttaggtaccgtttcgggaaacccggtaaaggggtaaccgtaaaaggggtaaactaaaacgttaacgaaaaccggtacgttagtacggaactacggacctaccgtaacgttctacggtttaccttaacc

SEQ ID NO: 443016 - DNA, 578 bp, Homo sapiens
  misc_feature: GZ8MTXP02FWLUM.2.7.A07.1.454.CMB.2.raw
  modified_base (382)..(382): a, c, t, g, unknown or other
  modified_base (394)..(394): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagagcccaccctctcctgcagggccagtcagagtattagcagcaacttagcctaggtaccagcaagaaacctggccaggcctcccaggcctcctcatctatgctgcactcccaccgacgggcccacgtcggtactcccagcctaggttccagtggctaggtgggtctggggacagtagttcattcncacatcagcacncctgctagtctagtaagttatttgaacttaaatttacttacttgtacaagtactaaagttattaaagtacgttgggtacggtaacgttcgggaacgtaaaaggggaccgtaaaaggtaacgtaaaactaccgtaaaacgtaacgtggtacggcttagaacctacgtattcgtacgtactttacc

SEQ ID NO: 443017 - DNA, 564 bp, Homo sapiens
  misc_feature: GZ8MTXP02GIMHS.2.7.A07.1.454.CMB.2.raw
  modified_base (344)..(344): a, c, t, g, unknown or other
  modified_base (363)..(363): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcaagaacctggccaggctccaggcctcctcatctatgctgcatccaccgagggcccatcggtactcccagccagtcagtgcaggtcggntggggacagagttcattcncacatcagcagcctgcagtctagaagtatttgacttaatttaattactgtacagtactaagttaataaataacgtggtacggtacgttacgggaccgtaaaggggaaccgtaaaggtaaacgtaaaacgtaacgaaaaccgtaacgttacggtacgggaacttacggacctaaccgtattacttacgtttacgtttaaccc

SEQ ID NO: 443018 - DNA, 653 bp, Homo sapiens
  misc_feature: GZ8MTXP02F3PUH.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcagggccagtcagagttatagcagctaacttagcctggtaccagcaacgaaacctggaccaggcctacccgaggtcctcctacatcctagtcgctgccactcccgaaccgacgggccctacgttcggtaacctccccgaaggtcccgtaagggttcaggtcggaccgtagggttcggggtctgggggactaggtacgtttcatttcaccactatcgacggcacgtccttgacctagttacgtaaggtaagttacttttcgaaactttaaagttttattaccgtaggtaccaaggtactaaagttattaaacgttaacgggttcgggtacggtaaccggttacgggaaccgtaaaagggggtaacctaaaaggggtaaactaaaacgttacgaaaacgtacgtggtaacgctacgctaaactgttccgttcttacttacg

SEQ ID NO: 443019 - DNA, 743 bp, Homo sapiens
  misc_feature: GZ8MTXP02G0HQ4.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctaccgaaggggaagacgcccaccctctcctgcgagggccagtcagagtatagcagacaacttagcctggtaccagacacgaacctggccaggcctcccgagcctcctcatctatgctgccactcccgaccgacgggccctacgttcggtaacctccccgacggtccctaacgggttccgaggttcgggacgtaggggttcggggtacgtgggggactaaggtacgtttctacgtttcacctaacctatacgaacgccgtaacggtccctaggacctaggttactaaggtaaagtttagttttacggtaaactttaaagtttttacttacgtttacggtacctaagtaccgttaaaagtttaaatttaaaacggttacggttacgggggttacgggttaacccgggtttaccggggaaacccgggtaaaacgggggtaaacccgtaaaaggggttaaaaccgtaaaacggtaaaccgtaaaaacgggttaaccgtagggttaccgggaactacgggtaacctaccgttaacgttccgtttaacggttcccttttaacccg

SEQ ID NO: 443020 - DNA, 615 bp, Homo sapiens
  misc_feature: GZ8MTXP02F49QX.2.7.A07.1.454.CMB.2.raw
  modified_base (193)..(193): a, c, t, g, unknown or other
  modified_base (550)..(550): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctcgaggggaancgccaccctctcctacgagggccagtcagagtatagcagcaacttagcctggtaccagcaagaacctggaccagggcctcccgaggtccctcctacattctatcgctgccaactcccaaccgagggcccacgtcggtaacctccccgagtcccgtaaggttcccaggtcggactagggttcggggtactaggggactaggtacgtttcactttccacaacctatccagaccacgcctagactagtctagtaattatttacgactttaaatttacttacgtgttacagttacgtaagttaactaaattacggtggtaacggtacgttacggaacgtaacgggtaactaaagggtaaanaaacgttaacgaaaacgtacgtaggcgtacaacgacctaacgtatcgttacgtacttactacccg

SEQ ID NO: 443021 - DNA, 576 bp, Homo sapiens
  misc_feature: GZ8MTXP02G7BMT.2.7.A07.1.454.CMB.2.raw
  modified_base (196)..(196): a, c, t, g, unknown or other
  modified_base (342)..(342): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccacctctcctgcagggccagtcagagtattagcagcaacttgcctggtaccagcagaacctggcaggctccagctcctcatctatgctgcactccaccacgggccactggtactccccagtccacggtttcaacgttggaccnggttaggtctgggggaccaggtcgttacagtttcactaccatcagcagcctgctagtctagtaagttacttttagacttaattttaactacttaggtacctaggtactaagttaactaatacgtaggtcgtacgttcgacggtaacggaccgtaaaggtaaacgaaacgttaacgaaaacggtacgtacgttacggaacttcggaaccttactaactcgttacgtctttaaccg

SEQ ID NO: 443022 - DNA, 661 bp, Homo sapiens
  misc_feature: GZ8MTXP02IYU8U.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctccgaggggaagacgccaccctctcctgcgagggccagtcagagtattagcagctaacttagcctggtaccagcaagaaacctggccaggcctcccgaggcctcctcatctatgctgcactccaccgacgggccagtcgtactccccagccgtacggttcaggtcggcgtagggtcggggtccgtgggggactaggtactttccgtaactttcccgtacaacccgtactaccgagacccgacgtcccgttgacgtacgttactagggtaatttacgttttactaactttaatttttacgttacttgtactacggtactaaagttaattaaacgtacggttacgggttacggtaacggttaccggaacgggtaaaacgggtaacgtaaaacggggttaacgaaaacgtaaacgtaaacggtaaacgtcggtacggtaacgtacggacctacgtacgttactcggtttacctttaacc

SEQ ID NO: 443023 - DNA, 670 bp, Homo sapiens
  misc_feature: GZ8MTXP02GYIUO.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggaccagcaagaacctggccaggcctcccgaggcctcctcatctatgctgcatccacagggccacgtgtactcccagccaggttcagtgcaggtcgggtctggggactaggtacgttcaagtttccactaacccgtatcccgtaaggcctacgccccgttaggcctaaggttctaaggaaagttactttttagactttaaatttttaacttaacgttggttaccaagggtaccttaaaggttaaacttaaagttaaaccggttgggggttacgggttaaaccgggtttaccggggaaaccccgtaaaagggggtaacccgtaaaagggtaaccgttaaaaacgttaaccggaaaacggtaaccgttggttaaacgggtcctacgggtaaccctaacgacgtttccttacgtttacctttaccg

SEQ ID NO: 443024 - DNA, 703 bp, Homo sapiens
  misc_feature: GZ8MTXP02F5T84.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcaagaacctggccaggctcccaggctcctcatctatgctgcatccacgacggccacgtcgtactccacgccacggttcaggtgcgaggtcggggttcgtcggggacaggtagttacctattccgtaccaccctaagtcctacgccgtaacgcccgtgtaccgtacggttacgtaagtaaaggtttaacgtttttaggtaaacccttttaaaatttttaaacttttacccgttaggtttacctaaagggtaccttaaaaggtttaaacttaaaagtttaaaccggtttacgggggttacggttaacccgggtttaccgggaaaacccggtaaaacgggggtaaaccgtaaaagggttaaacgtaaaaaaccgtacgtaaaaaccggaaacgttcgggttacgaacgttacggaacctaccctaagtttccgttacggtttctttaacccg

SEQ ID NO: 443025 - DNA, 563 bp, Homo sapiens
  misc_feature: GZ8MTXP02F4QFI.2.7.A07.1.454.CMB.2.raw
  modified_base (253)..(253): a, c, t, g, unknown or other
  modified_base (262)..(262): a, c, t, g, unknown or other
  modified_base (384)..(384): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggcagtcagagtattagcagcaacttagcctggtaccngcagaaccnggccaggctcccaggcctcctcatctatcgctgcatcccaaccgacgggccacgttcggtactcccgagcctaggttcagtggcaggtgggtctggggacaggtacgttcattcgtcactanctagcagccctgctagtctagtactatttgacttaatttatactgtacagtactaaatagtaaatacgttgggtaggaaccgtttcgggaaccgtaaagggtaccgaaaggttaaacgaaaacttacgaaaacgtaccgtggtagaacgtacggacctacgtatctacgttacttaccg

SEQ ID NO: 443026 - DNA, 703 bp, Homo sapiens
  misc_feature: GZ8MTXP02GVWYW.2.7.A07.1.454.CMB.2.raw
  modified_base (194)..(194): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgagggaangccacctctcctgcagggccagtcagagtattagcagacaacttagcctggtaaccagcaagaaacctggccaggcctcccgaggcctcctcatctatgctgctactcccacgacgggcctaagttcggtactccccgagtccgtaggttccaggttcggactaggtgggttctgggggactaaggtacgtttctacgtttcctaccgaaaccctagtcaaacggtccaacgggtcccttggacgtacggttccgttaaaggggtaaactttacgttttagtaaacctttaaatttttaacgtttacccgttagtaccgttaagggtacttaaaaggtttaaaacttaaacggtttaaccgttaggggttaacggtaccgggtttaacgggaaacccggttaaaacggggtaaaaccctaaaaggggttaaacaaaacgtaacgtaaaaacggtacgttagggttacgaacgtacgaaccttaccgagtttccgtacttacctttaccg

SEQ ID NO: 443027 - DNA, 626 bp, Homo sapiens
  misc_feature: GZ8MTXP02H9XNH.2.7.A07.1.454.CMB.2.raw
  modified_base (201)..(201): a, c, t, g, unknown or other
  modified_base (361)..(361): a, c, t, g, unknown or other
  modified_base (379)..(379): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagcccaccctgtctgtgtctccgaagggggaaanacgccaccctctcctgccgagggccagtcagagtatgcagcaacttagcctggtaccagcagaaacctggccacggctcccgaggtcctcctcatcctatcgctcgcactccccaaccgacgggccctagtcgtactcccgagccgtaggtccagtcggngtacgggtggggttacgnggggaactaggtacgtttacgactttccactacccagtccgagtcacgtcctgtacgtacgtagtacgtaaagtttctttagactttaaatttttatacgttgtacagtactaagttaaataacgttaacggtgggttaacggaccggttacggaacccgtaaggggaaaacctaaggggtaaacaaaacgtaacgaaaacgtacgttggagtaacgtacgactacgtactcgttacgttactaccg

SEQ ID NO: 443028 - DNA, 806 bp, Homo sapiens
  misc_feature: GZ8MTXP02I2IPE.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctcgaggggaancgccaccctctcctgcgagggccagtcaagtagtattagcagactaacttagcctaggtaccagacaaacgaaaccgtggaccacggccctaccccgaggtccctaccctacgtacttctagtcgactgaccactacccgaccggacgggccctagttcggtacctccccgagtccgtacggtttacgacggtcggacgtagggttcggggtcgtagggggacctagggttacgtttactacgtttacctaccgaaccctagtccgaaacggtacccgtacgtacccgttgggaaccttacggttacgttaacgggttaaaaggtttatttttaccgggtaaacttttaaacggtttttaaactttaccgtttcggtaaaccttaagggtaaacctttaaaagttaaacgtttaaaccgttaagggttaggggtttaaccggtaaacccgggtttaccggggaaaacggtaaaaccgggggaaaacggttaaacgggttaaaaccgaaaaaggtttaaaccgaaaacggttaaacggttcggtaaacggttaaccgaaaccggtaccgttaaaccctacggttttaaccgttaccgtttacttaaccccg

SEQ ID NO: 443029 - DNA, 645 bp, Homo sapiens
  misc_feature: GZ8MTXP02HFUF6.2.7.A07.1.454.CMB.2.raw
  modified_base (197)..(197): a, c, t, g, unknown or other
  modified_base (207)..(207): a, c, t, g, unknown or other
  modified_base (268)..(268): a, c, t, g, unknown or other
  modified_base (279)..(279): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctcncctgcagggccagtcagagtatagcagcaattgcctggtaccagcagaacctggccaggcnccaggctcctnatcatgctgaccatcccgacgagggccacgtggtactcccaggtccaggtttccagttggactaggttcggggtctgggggaacagggtacgtttcactttaccggaccaaccctattacgacgaccaacggtcccttaggactaacgtcgtaggtaaacgttagtttttcggaactttaaagtttttaacgttacttagttaccgaggtactaaggtaattaaacgttaaccgtagggttacgggtaaccggtttacgggaaccggttaaaccgggaaaccgtaaagggtaacggtaaaacttaaccgaaaacggtaaaccgtggtacggaactaggaccaccaaggttccctagttccttaccg

SEQ ID NO: 443030 - DNA, 557 bp, Homo sapiens
  misc_feature: GZ8MTXP02GV08C.2.7.A07.1.454.CMB.2.raw
  modified_base (198)..(198): a, c, t, g, unknown or other
  modified_base (361)..(361): a, c, t, g, unknown or other
  modified_base (383)..(383): a, c, t, g, unknown or other
  modified_base (389)..(389): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanagccaccctctcctgcagggccagtcagagtattagcagcaacttagcctggtaccagcagaaacctggccaggctcccagctctcatctatgctgcatccaaccagggccactggtactccagccagttcagtgcagtggtctgggacaggtagttcattcnatcatcagcagccctgcagtcngaagtntttgacttaaattttatacgtgttacgaagactaagttaacttaaagtaacgttgggtaggtaccgtttcgggaccaaaagggggtaaccctaaaaggggtaaacaaaacgtacgaaaaacgtaacttggtaacggactacggaccaaccgtaatccgttagtttacc

SEQ ID NO: 443031 - DNA, 527 bp, Homo sapiens
  misc_feature: GZ8MTXP02HGG4V.2.7.A07.1.454.CMB.2.raw
  modified_base (196)..(196): a, c, t, g, unknown or other
  modified_base (339)..(339): a, c, t, g, unknown or other
  modified_base (354)..(354): a, c, t, g, unknown or other
  modified_base (367)..(367): a, c, t, g, unknown or other
  modified_base (398)..(398): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacctggccaggcctccaggctcctcatctatcgctgcatccaccgagggccacgtggtactcccagccaggttcagtggcngttgggctggggacnggtagttcattcncaccatcagcagccctgcagtctaggaattntttcgactaagttttatactgttcagtactagtaataagtaactgggtcggacgttcggaacctaagggaccaaggtacgaaactacgaaaacgtactgtacgcgtacgacactagcttacgtacttac

SEQ ID NO: 443032 - DNA, 608 bp, Homo sapiens
  misc_feature: GZ8MTXP02H2UUM.2.7.A07.1.454.CMB.2.raw
  modified_base (197)..(197): a, c, t, g, unknown or other
  modified_base (416)..(416): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcaagagtattagcagcaacttagcctggtaccagcagaaaccgtggccaggcctcccgaggcctcctcatcctatcgctcgccactccccgaaccgacgggccctacggtcggtactcccccgaggcccgtagggttccaggttggcgtaggttcggggtctgggggactaggtcgtttcagtttccacacctntcagcacgccctgactagttctagtaacgtttatttgactttaaagttttatacttgtacagtctaagttaactaattacggtagggtacggtacgttcggaaccgtaaaagggacctaaagggtaaacaaacgtaaaccgaaaacgtacgtggtacgcgttacgacctacgtattccgttacgttccttac

SEQ ID NO: 443033 - DNA, 627 bp, Homo sapiens
  misc_feature: GZ8MTXP02H2MSX.2.7.A07.1.454.CMB.2.raw
  modified_base (199)..(199): a, c, t, g, unknown or other
  modified_base (476)..(476): a, c, t, g, unknown or other
  modified_base (569)..(569): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagcccaccctgtctgtgtctccgaggggaaanacgcccaccctctcctgcgagggccagtcagtagttatagcagactaacttagccgtaggtaccagacaacgaaaccgtggaccacggcctacccgaggtcctcctacatctatcgctgcactccaaccgacgggcctagtcggtacctccccgagtccgtaggttcaggtcggcgtagggttcgggtactgggggaactaggttacgtttctaatttcccgactaacccgtataccgacgctacgccgtagaccgtagtcgtaaaggtaacgtttntttagactttaaatttagttactagtacagtactaagttaataagttacggtggttacggacgttacgaaccggtaaaggacgtaaaggtaanaaacgtacgaaaacgtactaggagaacgtacgaaccgtactatccgtacgttactccg

SEQ ID NO: 443034 - DNA, 567 bp, Homo sapiens
  misc_feature: GZ8MTXP02FIUBU.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanagcccaccctctcctgcagggccagtcagagtattagcagcaacttagcctggtaccagcagaaacctggccaggcctcccaggtcctcctcatctatgctgccactcccaaccgacggggcccacgttcgggtacctccccgaaggtcccgtaagggtttcaaggttgggactagggtggggtcgtgggggacaggtagttccatttcacaccctatccgagcaggcctagccagtctagtaagtattttgacttaaatttactacgtgtcagctaagttataataagtgggtacggacgttcggacgtaaacgggacaaaagggtacaaagtacaaacgactgtacggctgaccactatcgagttctac

SEQ ID NO: 443035 - DNA, 563 bp, Homo sapiens
  misc_feature: GZ8MTXP02H2733.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccaagggggaaanagcccaccctctcctgcagggccagtcagagtattagcagcaacttagcctggaccagcagaaacctggccaggctccaggcctctcatctatgctgcatccacagggccactggtaactcccagccaggtcagtgctaggtggggtctggggaactagacgtttacagtttcacacccatccagcaacggcctcgcgtacgtcgtagtaagtagtttagtataatttaatttacttagtatagtataagtaataaataacgtaggtaggtacgttacggtaccgtaacggaacgaaaggtaaagtaaacgtaaacgaaacgtaaacgtacgtaggtaacgtcgacgacactcgtacgtacttacc

SEQ ID NO: 443036 - DNA, 657 bp, Homo sapiens
  misc_feature: GZ8MTXP02I7ULE.2.7.A07.1.454.CMB.2.raw
  modified_base (194)..(194): a, c, t, g, unknown or other
  modified_base (284)..(284): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcgagggaancgccaccctctcctgcgagggccagtcagagtatagcagcaacttagcctggtaccagacaagaacctggccaggcctaccgagcctccncattctatcgctcgtcactccacgacgggccacgtcggtactccccgagtcctaggtttccaggtcgacgtagggttcggggacctgggggactacggttagttcctaagtttcccacgactactcgaacggcacgcccttgactacggtcgttaagtaagttacttttagtaacctttaaattttacgttacgttacgtactaacgtacgttaaaagttaattaaacttaccgggttagggttaggttaaccggtccggaaaacccggtaaagggaaccgtaaaagggtaacggtaaaaataccgtaaaaacggtaacgttggaaccgtaacgtacgaacctaaaccgttgttaccgttacttacctttacg

SEQ ID NO: 443037 - DNA, 600 bp, Homo sapiens
  misc_feature: GZ8MTXP02JYWRR.2.7.A07.1.454.CMB.2.raw
  modified_base (425)..(425): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctaccgaggggaaagacgccaccctctcctgcgagggccagtcagagtatagcagcaacttagcctaggtaccagccaacgaacctggaccaggcctccgacggcctcctcattctatcgctgccacgtccacccgacgggcctacgtcggtactccccgagccgtacggttcaggtcgcgagggtgggttcgtggggactaggtcgttacacttctaccacctatacgacgacacggtccngcgtgtcgtaggtaacgttagtttacgtacttaaatttacttacgtgtacgtagtactaagtaattaagtacgtaggtcggtacggtcgaacggtaacggaacgtaaagaacgaaacgtacgaaacgtacgtaggtacgcgtacgacccgtactacgtcgttacgttacctaacg

SEQ ID NO: 443038 - DNA, 652 bp, Homo sapiens
  misc_feature: GZ8MTXP02HVLS2.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccaccctgtctgtgtctccgaaggggaaancgcccaccctctcctgcgagggccagtcagtagtatagcagactaacttgcctggaccagcaacgaaccgtggaccacggcctacccgaggtccctccgtactatctagtcgacctcgacctactacccgacccggacgggaccctacggtcgtacctaccccgacggtaccgtaacggttccgacggtcggtacggtagggttcggggtacgtcgggggaactaggtacttccgtactttccgacctaccgatcgacgacacgccgtgactagtacgtaagtaacgtttatttagtaactttagtttattacgttagtactagtacgttaagtaataacgttaggtgggtacgtacgggtacgaaccgggtaaggtaaccgtaaggtaaactaaacgtaacgaacgtacgtggtacgaacgtacgacgtacgtatttcgtacgttactttaccg

SEQ ID NO: 443039 - DNA, 540 bp, Homo sapiens
  misc_feature: GZ8MTXP02HKO33.2.7.A07.1.454.CMB.2.raw
  modified_base (200)..(200): a, c, t, g, unknown or other
  modified_base (266)..(266): a, c, t, g, unknown or other
  modified_base (274)..(274): a, c, t, g, unknown or other
  modified_base (283)..(283): a, c, t, g, unknown or other
  modified_base (371)..(371): a, c, t, g, unknown or other
  modified_base (404)..(404): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaagggggaaanagcccaccctctcctgcagggccagtcagagtatagcagcaacttgcctggtaccagcagaaaccngccaggcnccagctctnatctatgctgcatccaccgagggcctactggtaactcccgagccaggttcagtggctaggtggggtctggggacagagtttcatttcncaccatcagcagccctgccagtctagtaaagtnttttagacttaaattttatacttgtactagactaagtaataagtaacgtgggtacgtacgttacggacgaaaacgggactaaaggtaaacgaaaatacaaaacgacgttgtaggctgacacctagtcctgttactc

SEQ ID NO: 443040 - DNA, 722 bp, Homo sapiens
  misc_feature: GZ8MTXP02JXHFT.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacccccctggccaggcctcccgaggcctcctcatctatgcctgtcactacccaccgacggggtcccaacgttcgggtactaccccgacgtccgtacgggtttcgaggtcgggactagggttcggggtcgttcggggaccaagggtacgttcaacgtttctaccgtacctataccgaggcccaaggtccctagactacggtccttaaaggtaaagtttacgtttttacggaaacctttaaattttaacgtttacgttagtactaacggtacgttaaaggtttaatttaaaaccgttaaacgttggggttacggttaaccgggtttaccgggaaaccccggtaaaagggggtaacccctaaaaggggtaaacgtaaaaccggtaaccgttaaaaccggtaaccgttaaggttcggaaccgttacggaacctaaccggttacttacgttaccgtttctttacccg

SEQ ID NO: 443041 - DNA, 660 bp, Homo sapiens
  misc_feature: GZ8MTXP02FK6G1.2.7.A07.1.454.CMB.2.raw
  modified_base (197)..(197): a, c, t, g, unknown or other
  modified_base (290)..(290): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtcttgtgtctccgaggggaanacgccaccctctcctgcagggccagtcagagtattagcagcaacttgctggtaccagcaagaacctggaccaggcctacccgaggtcctcctnatctatgctgcatccaccgagggcccagtcggtactcccgagccgtaggttccaggtggacctagggtcgggtcgtgggggactaggtacgtttcgaatttccgacacctatccgaagtccaagcccttagggacctaggtctaaggtaaacgttattttagacttttaaattttacgttacgtcggttacaacgggttactaaaggtttaattaaaacggttaacgttcgggggtacgggttaaccggtttcggaaacccggaaaagggggtaacccgtaaaagggggttaaactaaaacgttaacccgaaaacggtaagttcggtacggaacgtcggaacctaccgagtttcctcggttacctttacg

SEQ ID NO: 443042 - DNA, 723 bp, Homo sapiens
  misc_feature: GZ8MTXP02FKTB3.2.7.A07.1.454.CMB.2.raw
  modified_base (295)..(295): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgcccaccctctcctgcgagggccagtcagagtattagcagcaacttagcctaggtaccagacaagaaacctggccaggcctcccgaggcctcctanatctatcgctgcactcccaccgacgggcccagtcggtacctcccgagcccgtaggttccaggtcggacgtaggtcgggtcgtggggacaggtagttcatttcaccgaactacgtacaacggtccaacgtcccgtgaccgtacgttacttaaggggtaaagtttaactttttggaaacctttttaaaagtttttaactttaaacccgtggtttaaccaagggttaacctaaaaggtttaaaattaaaagttaaccggggttaggggttaacggggttaacccggtttacccggggaaaaccgttaaaaaacgggggtaacccgtaaaaagggggtttaaacaaaaaaccgttaccggaaaaaccgttaacgtggggttaacgaaccgttacggaaccctaacgttacgttactccgtttactttaaccg

SEQ ID NO: 443043 - DNA, 669 bp, Homo sapiens
  misc_feature: GZ8MTXP02FJ7U0.2.7.A07.1.454.CMB.2.raw
  modified_base (413)..(413): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagacgcccaccctctcctgcagggccagtcagagtatagcagcaacttagcctggtaccagcaagaaacctggacccagggcctcccgaggcctcctacattctatcgactgaccatcccaaccgagggcccacgttcggtaacctccccgaggtcctacggggtttccagggtcggacgtagggtcggggtctgggggacaggtagttccagttcncaaccatcagcagccctagcagtctagtaacgtatttagacttaaagtttaacttactcggttacaagtctaaacgttaaattaaacgtaacggtttgggtacggtaaccggtttccggggaaacccgtaaaacggggtaaccccgtaaaaggggttaaaacgaaaacgttaaaccggtaaaaaaccgtaacggttcggttaacgggaactaccggtaaccaaacccgttattaccgttacgttacctttaacccg

SEQ ID NO: 443044 - DNA, 810 bp, Homo sapiens
  misc_feature: GZ8MTXP02GLPKM.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctggtaccagcagaacctggccaggcctccaggcctcctcatctatgctgaccactcccaccgacgggcccacgttcggtaacctccccgaggtcccgtacggtttccaggtcgggccgtagggtcggggttcgtgggggaacctaggggtacgtttccgtaactttccgtacctaaacccgtagttacccgaaacggcccgtaacgggtccccgtaggtacccgtaacgggtttacccgttaaagggtaaaagtttacgtttttacggaaacccttttaaaagttttttaaaccgtttaaccggtttacggtaaccgttaaacgggttacccttaaaaggttttaaaacgttaaaacggtttaaaccggtttcgggggttaaccggggttaaacccgggtttaccgggggaaacccccggttaaaaagggggtaaccccgttaaaaagggggttaaaacgtaaaaaccgttaaaccggtaaaaaaccggttaaccgttaggggttaccggaaccgttacggaacctaacccggtactttaccgttacggtttacctttacccg

SEQ ID NO: 443045 - DNA, 674 bp, Homo sapiens
  misc_feature: GZ8MTXP02HBGQP.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangcccaccctctcctgcagggccagtcagagtattagcagctaacttacgcctaggtaccagcaagaacctggccaggcctcccgacggcctcctctatctatgctgccactcccaacgcgggccagtcggtactcccgagtccacggtttcaggtcggcgtaggttcggggtacgtcggggaacagggttacgtttacgtaactttcccgtacacccgtaattccgaacggtccacggtcccttgacctagggttcctaagtaagtttagtttacgaactttaaacttttacgtttaccttagttacgtaacggtaattaaggttaattaaacggtaacggtttgggtaccgggttaaccggttcgggaaaccgtaaaacggggtaccgtaaaagggtaacgtaaaacgtaccgaaaaggtaaccgtgggttacgaaccgttacgaccctaacgtactttcgttacgtacctttccg

SEQ ID NO: 443046 - DNA, 674 bp, Homo sapiens
  misc_feature: GZ8MTXP02GMQFA.2.7.A07.1.454.CMB.2.raw
  modified_base (652)..(652): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcagggccagtcagagtattagcagcaacttagcctggtaaccagacaacgtaaacctggacccagggccctccccgaagggtcctccctacaattcctaatcgactcgaccactccccaaccgagggcccacgttaggtacctaccccgaggtaccgtacgggttccaaggttgggacctagggtcggggtctgggggacaggtacgttcaactttcaccacctagtcacgctacgcctgacctagtactaggtaagttactttgaaaccttaaatttacgttaactgttacaggtaactaaagttataaacgttaaagtgggttacggtaaccggtttaccgggaacgtaaaacgggggtaaacctaaaagggtaaacgtaaaaccgtaaccgtaaaaacgtaccggttagggtaacgtaactacgaccgttaaaccngtttaccgtcgttacctttacc

SEQ ID NO: 443047 - DNA, 746 bp, Homo sapiens
  misc_feature: GZ8MTXP02HRVJS.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaaagacgcccaccctctcctgcagggccagtcagagtattagcagcaacttacgcctaggtaccagacagaaacctggccaacggcctacccgaggtcctcctctatctagtcgctgccactcccaccgagggccctacgtacggtactaccccgaggcccgttacggttccgaggtcggaccgtagggttcggggttcgcgggggactaaggtaccgtttcgtaatttcctactacccgtaaattccgacgccgtacggtcctcgtacgacggtttaccgtagggtaaacgttagtttttaacgtaacctttaatttttaacctttaacgtttcggttactaacgtaccgttaaaggttaaaacttaaaccggtttaaaggttacgggttaacgggttaaccggggtttaacccggggaaacccgggtaaaacgggggtaaacccgttaaaagggggtaaactaaaaccgttaaacggaaaaccgtacgtttacgggaggtaaccgttacggaacctaacgtactttacggtaccgtttaacttttacccg

SEQ ID NO: 443048 - DNA, 823 bp, Homo sapiens
  misc_feature: GZ8MTXP02FUJ3Z.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagcaacttagcctaggtaccagcaagaaacctggaccaggcctcccgaggcctcctcatctatcgactgccataccccgaccgtacggggaccctaacgttcgggtacctccccgaggtcccgtaacgggtttccgaagggtcgggaccgtaggggtcggggttcgtgggggaaactagggtaggtttaccagtttccacctaacccgtaattccgaaacgtcccgtaaacggtcccgttaggtaccgtacggttaccgtaaggttaaagggtttactttttacggaaccttttaaaactttttagtttaaaccgttggtaaccctaagggttaacttaaaagtttaaaacgttaaaacgtttaaaccgggtttagggggttacgggttaaaccccgggtttaaccgggggtaaaccccggtaaaaacgggggtaaacccgttaaaaagggggtttaaaacgtaaaaaaacggttaaacccggtaaaaaaaccggggtaaacggttaacgggtttaaccgggggaacctttaacggggaacccttaaccgtaaaaccgtttccgttaccggtttaacttttaaccccg

SEQ ID NO: 443049 - DNA, 551 bp, Homo sapiens
  misc_feature: GZ8MTXP02GYQSW.2.7.A07.1.454.CMB.2.raw
  modified_base (196)..(196): a, c, t, g, unknown or other
  modified_base (322)..(322): a, c, t, g, unknown or other
  modified_base (391)..(391): a, c, t, g, unknown or other
  modified_base (425)..(425): a, c, t, g, unknown or other
  modified_base (514)..(514): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanacgccaccctctcctgcagggccagtcagagtattagcagcaacttgcctggtaccagcagaacctggccaggcctcccaggcctcctcatctatgctgcactcccacgacgggccagtcggtacncccgaggccgggttcaggtcggcagggtcgggtccaggggacaggtacgtttcactttcctacaacctntcacgcacgtcctgactagtacgtagtaaagttnttttagacttaaattttattactgttacagtactaagttaataagttaacgtggtaggacgttacggacgaaggtacaaaggtagaaanacgaaacgactagtgactgacactatctgtctcgtac

SEQ ID NO: 443050 - DNA, 598 bp, Homo sapiens
  misc_feature: GZ8MTXP02HTQAW.2.7.A07.1.454.CMB.2.raw
  modified_base (305)..(305): a, c, t, g, unknown or other
  modified_base (311)..(311): a, c, t, g, unknown or other
  modified_base (391)..(391): a, c, t, g, unknown or other
  modified_base (427)..(427): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaagggaaagacgcccaccctctcctgcagggccagcagagtatagcagacaacttagcctggaccagcaagaaacctgaccacggcctcccgaggcctcctctatctatgctgcacnccacgnggccagtcgactaccccagcgtacgtcagtcgcgtaggttcggtcgtgggactaggtattcctaatttccacaccctaanacgagcgacgtccgtgactagtacgtagtaacgttntttacgtaatttaatttatactgtatagtactaaagttaattaaacggttaggttacgggtaacggttaccggtacggaacggtaaacggtaaacgtaaaggtaaactaaaacgtaacgaaaacgtacgtacggtacgaacgtacgacctactacgttcgtacttactacg

SEQ ID NO: 443051 - DNA, 607 bp, Homo sapiens
  misc_feature: GZ8MTXP02FKBKY.2.7.A07.1.454.CMB.2.raw
  modified_base (283)..(283): a, c, t, g, unknown or other
  modified_base (342)..(342): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttagcctggtaccagcagaacctggccaggctcccaggctcctnatctatcgctgcatcccaccgacgggccacgtggtactcccagcctaggttcagtggcnggtggtctggggacaggtgtttcattccacaacctatcagcacgccctgactacggtctagtaagttacttttgaacttaattttaagtacttgtacctaaggtctaaaggttaattaaacgttacggttagggtacggtaaccgtttacgggacccggtaaaagggggacccgttaaaagggggtaaacaaaacggttaacgaaaaacggtaacgttagggtacggaacttcgggaactaccgtattaccggtcttactttccg

SEQ ID NO: 443052 - DNA, 563 bp, Homo sapiens
  misc_feature: GZ8MTXP02FRB28.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagacgcccaccctctcctgcagggccagtcagagtattagcagcaacttagcctggtaccagcaagaacctggccaggcctcccgaggcctcctcatctatcgctgccatcccaccgagggccctacgtcggtaactcccgagtcctaggttccaggtggctagggtcggggtctggggacaggtagttccatttccacacctatcagcagcctgcagtctagtagtatttgacttaaatttatactgtacagtactagttaataagtacgtggtaggacgttcggaacgtaaacgggtacaaaggtaacaaactacgaaaacgtacgtggtaggcgtacgacctactagttacgtcgttacttacg

SEQ ID NO: 443053 - DNA, 706 bp, Homo sapiens
  misc_feature: GZ8MTXP02I43K9.2.7.A07.1.454.CMB.2.raw
  modified_base (197)..(197): a, c, t, g, unknown or other
  modified_base (285)..(285): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcaagaacctggaccaggcctcccgaggcctcncatctatcgctcgctactcccgaccgcgggaccctacgttcggtaactccccaggtcctacgggtttccgaaggttcgggactaaggggtttggggtaccgtgggggaacctaggggtaacgtttccaacgttttcccacacccgtaaagtccgaaagcccgaacggtcccttgacccgttaggtacctagggttaaaacgttacttttaggtaaacctttaaatttttacttacggtctactaacgggtactaaagttaacgtaaaattaccgggttggtacggttacgttaccgggaacgtaaaacggggtaacccgtaaagggtaaacgtaaaacgttaccggaaaaacgtacccgttggggtaccggtaaccgttaacgacccttaacccgtagtttcccttagtttcctttacccg

SEQ ID NO: 443054 - DNA, 577 bp, Homo sapiens
  misc_feature: GZ8MTXP02G77BQ.2.7.A07.1.454.CMB.2.raw
  modified_base (198)..(198): a, c, t, g, unknown or other
  modified_base (565)..(565): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaangccaccctctcctgcagggccagtcagagtatagcagcaacttgcctggtaccagcaagaacctggccaggcctcccaggcctcctcatctatgctgcactcccaccgacggggcccaacgtcggtaactccccgaggtccacgggtttcaggtcggctagggttcggggtcgtgggggactagggtacgtttacaagtttccacaacctatccgaagcaacgcctgactacgtacgtagtaagttattttcgaactttaaagttttatacgttagtacagtactaagtaactaagttacgtggtacgtacgtcggaacgtaacgggacaaaggtacaaacacgaaacgtatgtagctgactacctntactacgtctac

SEQ ID NO: 443055 - DNA, 685 bp, Homo sapiens
  misc_feature: GZ8MTXP02JOVPW.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgcagggccagtcagagtattagcagcaacttagcctggtaccagccaagaaacctggccaggcctcccgaggtcctcctcatctatgctgcactccaccgacgggccctacgtggtaactccccgagtccgtacggtttcaggtggcgtaggttcggggtctcgggggacagggtacgtttcatttccgtaccaccagtacacgctacggcccttgacgtacgttctaggtaaagttatttagtacttaaatttttacgttacgtttaggtacctaggtacgttaaaagttaagttaaacgtttaaccgttaggggttacgggttaaccggttaccggggaacccggtaaaacggggtaaacccgtaaaaggggttaaacgaaaacgttaaccggaaaaacggtaaccgtgggttaaccggaacttaccggaaacctaccgtaaacggtttccttacggtttacctttaaccg

SEQ ID NO: 443056 - DNA, 699 bp, Homo sapiens
  misc_feature: GZ8MTXP02FNUR9.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagactaactgcctaggtaccagcaacgaaacctggccaggcctacccgaggcctcctacatctatcgctgcactcccgaaccgacgggccctagtcggtaactccccagccctagggttccagtggacgtaggtcggggttctgggggaactaggtagtttcaatttccctacgaccctaatccgaaacggcctaacggtcccttggacctaggttaccgttaggtaaaagtttagttttacgtaactttaaaatttttaacgtttacgtaggttactaacgggtaactaaaggtttaattaaacgttaaacgggttggggtacggtaaaccgggtttcggggaaaccggtaaaaacggggtaccgtaaaagggtaaacgtaaaacgttaaaccggaaaaacgtaacgttgggttacgggaacttacggaacctaccaagtttccgtacggtttctttaacccg

SEQ ID NO: 443057 - DNA, 677 bp, Homo sapiens
  misc_feature: GZ8MTXP02JICIL.2.7.A07.1.454.CMB.2.raw
  modified_base (195)..(195): a, c, t, g, unknown or other
  modified_base (459)..(459): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaancgccacctctcctgcacgggccagtcagagtattagcagacaacttagccgtaggtaaccagacaacgaaacccgtggaccgacggcctaccccgacggtccccttcctactactctagtcgctgccactcccgaccggacgggcctacgttcggtaacctcccgacggtaccgtacgggtttacgacgggtcgaccggtaggggttcggggttcgtacgggggaactacgggtacgtttccgtacttacctaccaaccttacncgacgtaccgacgtctagtacctaggtacgttagtaattagtttcttaaacttatttacttacgtctacgaattacgtaaagttaactaagttaggtggtacgggttaaccgtacggaaccggtaaaaggggtaaacctaaaggggtaaactaaaacgtaacgaaaacggtactagggtacgaactacggacctaaaccgttgtccttacgtcctacg

SEQ ID NO: 443058 - DNA, 805 bp, Homo sapiens
  misc_feature: GZ8MTXP02HRZH3.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaanacgccacctctcctgcgagggccagtcagagtatagcagctaactagccgtaggaccagcaagaaaccgtggaccacggcctacccgaggtcctcctacatcctatcgctcgacactcccgaacgacgggccctaagtcggtacctaccccgaggtccgtaacgggtttcaaggtcggacgtagggttggggtccgtggggaactagggttacgtttacctaacgtttccgaaccctaacccttaacgtaccgaaacggtacccgtaaccggtcccgtaacgtaccgttaacggttacgttaaagggttaaaacggttttactttttaacgtaaaactttttaaacgtttttaacgttaaccgttaggtaaacctaaggttaaacttaaaagtttaaaaacgttaaaacggtttaacggggttaacgggggttaaccggttaacccgggtttaaaaccggggaaaacccgggtaaaacggggtaaaaccggtaaaaagggttaaaacgtaaaaaccgtaaaaccggtaaaaaccggttacggttacgggtacggtaaccgtaacgaaacccttaacgtaacgtttaccgttacgtttaacccttaccg

SEQ ID NO: 443059 - DNA, 676 bp, Homo sapiens
  misc_feature: GZ8MTXP02GHKWA.2.7.A07.1.454.CMB.2.raw
  modified_base (668)..(668): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcagggccagtcagagtattagcagacaacttagcctggtaccagcaagaacctggccaggcctccgaggcctcctctatctatcgctgcactcccaccgacgggcccacgttcggtactccccgaggccgtacggttccaggtggaccgtagggttcggggtcgtggggactaggtacgttactacgttcactaaccctagtccaacggcctaacggtccctaggtactaacggtttaccgtaaggttaaagttacttttttacgaaactttttaaaatttttaacgtttaacctttagggtacctaaggttaaccttaaagttaaaattaaaacgttaacggttaggggttacggtaaaccggtttacgggaaacccgtaaaaggggaaacccgtaaaggttaaacgaaaacgttacgaaacgtaagttcgtagcgtcgaactacgattccgtntaccttac

SEQ ID NO: 443060 - DNA, 643 bp, Homo sapiens
  misc_feature: GZ8MTXP02G3A61.2.7.A07.1.454.CMB.2.raw
  modified_base (197)..(197): a, c, t, g, unknown or other
  modified_base (615)..(615): a, c, t, g, unknown or other
  modified_base (627)..(627): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggcctcccgaggcctcctacatctatcgctgcactccccgacgacgggccacgtcggtacctccccgagtcccgtaggttccgaggtcggcgtaggtcggggtcgtggggacacggtacgttccatttccacaccctaatccgacgacgacggtcccttgaccgtagttccgaagtaaacgttattttcggaaactttaaatttacttacgtaggtacctagtaagttaaacggtaaacttaaaacggtaacggttcggggtaaccgggtaacgtttcccggaaaccggtaaaacggggacccgtaaaggttaacgaaaacttacggaaaacgtacgtgtaacgntacgacctactntcgttactactttacc

SEQ ID NO: 443061 - DNA, 561 bp, Homo sapiens
  misc_feature: GZ8MTXP02FVCEK.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggctcccaggcctcctcatctatgctgcatccaccgacgggccacgtggtactcccgagcctaggttccagtggctaggtcggggtctgggggacaggagttccatttcacaccatcagcacgcctgaccagtctagtaagtatttagacttaaatttattaacttgtacagactaagttaataaatacgtaggtcggaacgttcgggaactaaacggggaccaaaagggtacgaaaatacgaaaacgtaactggtaacggcttaggacctaccgtatctacgttcttacc

SEQ ID NO: 443062 - DNA, 730 bp, Homo sapiens
  misc_feature: GZ8MTXP02GU1RW.2.7.A07.1.454.CMB.2.raw
  modified_base (287)..(287): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggaaagagcccaccctctcctgcgagggccagtcagagtattagcagcaacttagcctggtaccagcagaacctggccaggcctcccaggcctcctanatctatgctgccactcccaccgacgggccctacgtcggtacctccccgagtccccgtaaggttcaggttcgggaccgtagggtcggggtacgtgggggaacctaggtaggtttccaagtttcccgtaccaaacccgtactcgacgtaccgtacggcccttggaccgtacgggttacttacggtaaagtttaccgttttagaaacctttaaatttttacttacgtttaggcctaaggtaccttaaaggttaaacttaaaaggttaaaccggttggggtttaaccgggtaccgggtttaaaccggggaacccggaaaaacgggggtaacccgtaaaagggggttaaacctaaaaacggttaccggtaaaaaacggtaaccgttggggtacccgtaacgtaccggaacctaacccgtagttttaccctaggttttacccttaaccg

SEQ ID NO: 443063 - DNA, 643 bp, Homo sapiens
  misc_feature: GZ8MTXP02HRZYA.2.7.A07.1.454.CMB.2.raw
  modified_base (197)..(197): a, c, t, g, unknown or other
  modified_base (260)..(260): a, c, t, g, unknown or other
  modified_base (267)..(267): a, c, t, g, unknown or other
  modified_base (275)..(275): a, c, t, g, unknown or other
  modified_base (284)..(284): a, c, t, g, unknown or other
  modified_base (287)..(287): a, c, t, g, unknown or other
  modified_base (298)..(298): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctcttctgcgagggccagtcagagtatagcagcaacttgcctggacagcagaacngcaggcnccagctcncatctatcnctncatcccaccgngggaccctacgtggtactccccgagtacccgtagggttaccaggtcggaccgtagggtcggggtactgggggaacaggtacgttctagttcaacctaccgatacgacgcgacgccctgtaccgtagttaccgtaggtaaagtttcgtttagtaactttaattttaacgttacgtttggtaacaaggtacctaaagttactaaagtaacggttggtacggtacggttaccgggaacgtaaacgggaaccgttaaaagggtaaataaaacgtaaacggtaaaacggtaacggttgggtaaacggtcttacggaacctacgtaactttccgtacgtttaccctttacc

SEQ ID NO: 443064 - DNA, 589 bp, Homo sapiens
  misc_feature: GZ8MTXP02JONH8.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaacctggccaggcctccaggcctcctcatctatcgctgccatcccaccgagggcccagtcggtaactccccgaggtccctagggttccaggtcggactagggttcggggtactgggggactaggtcgttcattccacactatcagcacgcctgactagtctagaagttattttcgacttaattttactacttgtactagtactaaagttaactaagtaacgttgggtacggtaccgttacggaccgtaaaaggggacctaaagggtaaacgaaactaacgaaaacgtaacgttggtacggctacggacctacctatccgtcgtactttacg

SEQ ID NO: 443065 - DNA, 609 bp, Homo sapiens
  misc_feature: GZ8MTXP02JNJMF.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcagggccagtcagagtattagcagcaacttagcctggtaccagacagaaacctggccaggcctcccaggcctcctcatctatgctgcactcccaccgagggcccacgtggtactccccgagccctaagggtttccaggtggacctagggtggggtctgggggacctaggtacgtttcatttcctacaccctatccagccagcctgactagtctagtaacgttattttgacttaaatttattacgttgtactagtactaagttaactaaagtacgttggtacggtacgttacggaccgtaaacggggaccgtaaagggtaaacgtaaaacgtacaaaaccggtaaacgttggtacggtaacctacgacctaaccgtattaccgttacgttactttaccg

SEQ ID NO: 443066 - DNA, 746 bp, Homo sapiens
  misc_feature: GZ8MTXP02FOFHR.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagcccaccctctcctgcacgggccagtcagagtattagcagacaacttagcctaggtaccagacaagaacctggccaggcctcccgaggcctcctcatctatgctgcactccccgaaccgacggggccctacgttcggtaacctccccgagtcccgtaagggttccaggtcgggaccgtaggggtcggggttaccgtgggggaaacctagggtaacgtttacctacgtttacctaaccgaacctacgtaccgaacgcgtacggtccctaggaccgtaggtttacgtaaggtaaacgttttactttaccggaaattttaaaactttacgttaaccgttggtaactaaacggttacgttaaaattaaacgttaaaacgtttacgggggttagggttaacggggttacccggtttaccgggggaaaaccggttaaaacggggtaaccggttaaaaggggtaaaactaaaacggttaaaccggaaaaaccgttagttcgggtaacgtaaccgtacgaaccaccgttatttcccgtacggtttacccttaaccg

SEQ ID NO: 443067 - DNA, 719 bp, Homo sapiens
  misc_feature: GZ8MTXP02IRU32.2.7.A07.1.454.CMB.2.raw
  modified_base (362)..(362): a, c, t, g, unknown or other
  modified_base (446)..(446): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagcgccacctctcctgcgagggccagtcagagtattagcagactaacttacgcctaggtaccagacaagaaacctggacccaggccctacccgacggtccctacctcattcctagttcggcctcgaccacctcccgaccggtacgggccctacggttcggtaaccccnccccgtaacggtcccgtaggtccgtaggtcggacgtggggtcggggtacggtggggactaggtcgttactacttccgaccactntacgacgcacggtctagacgtacgttacgtaagttaaagtttcgtttactaaacttttaattttacgttacttcgtaacgtacgttaacgttaaagttaacgttaaacggtttacggtacggggttacggttaaccggttaccgggaaaccggtaaaacggggtaaccgtaaaacgggtaaaacgtaaaaccgtaaccggttaaaacgtacggtttgaaccggtaaccgtacgtaccgttaaacgttacgtttcggtttaactttaccttacg

SEQ ID NO: 443068 - DNA, 551 bp, Homo sapiens
  misc_feature: GZ8MTXP02GDFMV.2.7.A07.1.454.CMB.2.raw
  modified_base (537)..(537): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaagagccaccctctcctgcagggccagtcagagtattagcagcaacttagccctggtaccagacagaaacctggaccaggcctcccgaggcctcctcatcatgctgcatccaccagggccacgtggactcccagccaggttcagtggctaggtcgggtctgggggactaggtacgttcattcctacaccaatcaagcagtccctgcagtctagaagtattttgacttaatttattactgacagactaataataacgtacgtggtaggtacgttcggactaaaagggaccaaaagggtaacaaaatacgaaaacgtaactggtacgaacttacgactaaactntacgtgtacttacc

SEQ ID NO: 443069 - DNA, 724 bp, Homo sapiens
  misc_feature: GZ8MTXP02H22K5.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaanacgccaccctctcctgcgaggccagtcagagtatagcagctaactagcctggtacagcagaacctggccaggcctccgagcctcctcatctatcgctcgcactacccaccgacgggccctacgtcggtaacctcccgagtccgtacggttccaggtcggaccgtagggttcggggtctacgggggtactaaggtaccgtttactactttcccgacctaccgtatccgacgaccgtacgtccctaggtaccctaggttacggtaaagttaaacgtttagttttacggaaccttttaaaattttttcgttaaaccgttttgggaaaccctaagggttaccttaaaaagggtttaaacttaaaacgggttttaaccgggtaggggtttaaccggtaaccggggtttaaccgaaacccgggtaaaaggggtaacccgttaaaaggggtaaaactaaaaacgtaaccggtaaaacgtcgttaacggtacggttaacacggaacctacgtagtttccttacgtttaccctacg

SEQ ID NO: 443070 - DNA, 551 bp, Homo sapiens
  misc_feature: GZ8MTXP02GCAOX.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagagcccaccctctcctgcagggccagtcagagtattagcagcaacttagcctggtaccagcaagaaacctggccaggcctcccaggcctcctcatctatgctgcatcccaccgacgggccacgtcggtactcccgagcctaggttcagtggcaggtgggtctgggggacaggtagttcattcacactatcagcagcctgcagtcagtaatatttgacttaatttattactgtactagactaagttaataagttacgtggtacggtacgttacggaaccgaaagggtaaccgaaaggtaaacgaaatacgaaaacgtaacgtggtacggctacgacacctgtctagttactaccg

SEQ ID NO: 443071 - DNA, 538 bp, Homo sapiens
  misc_feature: GZ8MTXP02FWZVY.2.7.A07.1.454.CMB.2.raw
  modified_base (204)..(204): a, c, t, g, unknown or other
  modified_base (249)..(249): a, c, t, g, unknown or other
  modified_base (257)..(257): a, c, t, g, unknown or other
  modified_base (273)..(273): a, c, t, g, unknown or other
  modified_base (306)..(306): a, c, t, g, unknown or other
  modified_base (377)..(377): a, c, t, g, unknown or other
  modified_base (499)..(499): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccagggaaagagccaccctntcctgcagggcagtcagagtattagcagcaacttagctggtaccngcagaacngcaggctccagctctnatctatgctgcatccaccagggccactggtacnccagccacggttcagtggcagtggtctggggacaggagttcattcacacatcagcagctgcagtctagaanattttgactaatttattactagtctagactaagtaattaaaataacgtggtaggaccggtttacggaccgaaaacggggaaccgaaaaggggtaaacgaaaacttaccgaaaaacgtaaacnggtaggtccttacgaaccacgtctacgtaccttctaacc

SEQ ID NO: 443072 - DNA, 537 bp, Homo sapiens
  misc_feature: GZ8MTXP02GRNYO.2.7.A07.1.454.CMB.2.raw
  modified_base (197)..(197): a, c, t, g, unknown or other
  modified_base (342)..(342): a, c, t, g, unknown or other
  modified_base (360)..(360): a, c, t, g, unknown or other
  modified_base (381)..(381): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaanagccaccctctcctgcagggccagtcagagtatagcagcaacttagcctggtaaccagcaagaaacctggccaggcctccaggctcctcatctatgctgcatccaacagggccatgtatcccagccaggtcagtggcagtggtcnggggacagagttcattcncaccatcagcagcctgcagtntagtaagtattatataatttattattagtatagataagtaataaataacgtaggtaggtacgtacggacggaaacgggaacgaaaggtaaacgtaaaagtaaacgtaaaacgtaaacgtagtaggtaacgtacgacgacactactacgttacttac

SEQ ID NO: 443073 - DNA, 533 bp, Homo sapiens
  misc_feature: GZ8MTXP02GSMBA.2.7.A07.1.454.CMB.2.raw
  modified_base (196)..(196): a, c, t, g, unknown or other
  modified_base (281)..(281): a, c, t, g, unknown or other
  modified_base (300)..(300): a, c, t, g, unknown or other
  modified_base (516)..(516): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacctgccaggctccaggctcctnatctatgctgcatccaccngggccatgtactccagccaggttcagtggacaggtgggtctgggggactaggtagttcattctcaccatccagcacgacctgcagtctagtaaggtatttagactaatttattacttgtctagacaagtataaatacgtggtagtacgttcgacgtaaagggaccgaaaggtaagaaactaacgaaaacgtacgtagtaggtaaccagacaaaccntactcgttactttaccg

SEQ ID NO: 443074 - DNA, 732 bp, Homo sapiens
  misc_feature: GZ8MTXP02FM1LD.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgccaccctctcctgcagggccagtcagagtattagcagcaacttagcctaggtaccagcaagaaacctggccaggcctcccgaggcctcctcatctatcgactgcatcccaccgagggcccacgtggtactcccagcctaggttacagtggcgtaggtcggttacgtggggactagggtagttctaatttccgtaccaacctagttccgaacggcccaacggcccttcgggacctaacggttaccgttaagggtaaagtttaacgtttttaggtaaacccttttaaagttttaaacttttaacgttacgttaccgtaagggtacctaaaggtttaaattaaaacgttaaggtttacgggggtaacgggttaaccgggtttacccgggaaccggtaaaaccgggggtaaaacccgtaaaaggggtaaaccggtaaaacgttaaaccggtaaaaaccgggtaaacgttcggggttaacggtaaccgttacggaacccgtacctaacgtttaccgtttaacgtttccgtttaacccg

SEQ ID NO: 443075 - DNA, 528 bp, Homo sapiens
  misc_feature: GZ8MTXP02GRMD6.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccgaggctcctcatctatgctgcatccaccagggccatggtatcccagcctaggtcagtgcaggtgggtctggggacaggagttcattctacaccatcagcagcctgcagtctagaagtattttgactaaatttattactgtcagacagtataataactggtagtacgttacgacgaacgggaacccgaaaggtaacgaaaagtaccaaaacgaaccgttagtaggaactacgacaacctattccttacgtactc

SEQ ID NO: 443076 - DNA, 829 bp, Homo sapiens
  misc_feature: GZ8MTXP02H85TI.2.7.A07.1.454.CMB.2.raw
  modified_base (198)..(198): a, c, t, g, unknown or other
  modified_base (451)..(451): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctccagatgccactggagaagtggtgatgacgcagtctccagccaccctgtctgtgtctccgaaggggaaanacgcccaccctctcctgcgagggccagtcaagtagttatagcagactaacttagcccgttaggtaacccagacaacgaaaacccgtggcccaacgggcctacccccgaggccccttcctactattacccgtagttcgcgttaccgaccacgttaccccgaaccggacggggcccctaaggtccggtaacctcccccgaaggtcccgtacgggtttcgaacggttcggggaccggttagggttcggggttacgngggggtaaacctggttaacggttcctactttcccactaaccctacgttacgaacgtccgtaccgtaccgttcggaccgttacggttaccgttagggtaaaacggttttattttacggaaactttttaagtttttaaccttaacgggtttcgttaactaagggtaactttaaagttaaaacgttaaaggttaacgggtacggggtttaacgggttacccgggtttaacggggaaaacccggtaaacggggtaaaaccggtaaaaggggtttaaaacaaaaccggttaaaccgaaaaccgttaacgggttaggtaacgggttaaccctaacgggacccgttaaacttaacggttccctttacggtttaccctttaacccg

SEQ ID NO: 443077 - DNA, 616 bp, Homo sapiens
  misc_feature: GZ8MTXP02G8K8P.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctaccgaaggggaaagacgcccaccctctcctgcagggccagtcagagtatagcagctaatgcctggtaccagacaagaaacctggccaggcctacccgaggtcctcctacatcctagtcgctgaccactcccgaaccgacggggcccaacgttcggtaacctaccccgaggtacccgaaggtttcccaagggttcggacgtagggttcggggtactgggggaactaggtacgtttcctagtttccacaaccctagtcgagtacacgccgtagctagtctagaattatttgaacttaatttatacgttgtacagtactaagttaaataagtacgtagggttacgaccgttacgaccggaaacggaacgtaaagggtaaactaaactacgaaaacgtacgttaggcggaactagaccacgtatctgttactacg

SEQ ID NO: 443078 - DNA, 530 bp, Homo sapiens
  misc_feature: GZ8MTXP02JLI30.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttgcctggtaccagcagaacctgcaggctcccaggctctcatctatgctgcatccaccgagggccactggtactccccagccaggttcagtcggcaggtcgggtctggggacaggtagtttccagttcctacacctatcagcacggcctgacagtctagaagtatttagacttaatttatactgtcagtcagtaataatacgtggtaggtacgttcggactaaaggggacctaaagggtacaaagtaccgaaaacgaacgtgtaggctagacacctagtcttacgtcttac

SEQ ID NO: 443079 - DNA, 702 bp, Homo sapiens
  misc_feature: GZ8MTXP02IYDIT.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtcgtctccgaggggaagacgccaccctctcctgcacgggccagtcagagtattagcagcaacttagccctaggtaaccagacaacgaaccgtcggaccacggcctcccgacggcctccctacacttctatgcctcgaccactacccgaccggacgggccctaacgttcggtaacctcccgagtcccgtaggtttccaggtcggccgtagggttccggggttctagggggacctaggttacgtttaccgtactttcccaccaactacgtacgacgtccgaacggtccgttacgccgtaagttccgttaaagtaacgtttatttttacgaacttttaaagttttacttacggtcgtacctagtaaccgttaaagttaactttaaagttaccggttgggggtacggttaccgggtacggacccggttaaaaggggtaccgaaaggttaaacgaaaactaccgaaaacggttaagtgggtacggtcctacgaacccgtactacgtttccgttactttcctttaacg

SEQ ID NO: 443080 - DNA, 600 bp, Homo sapiens
  misc_feature: GZ8MTXP02HHL91.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtatagcagcaacttagcctaggtaccagcaagaaacctggccaggcctcccaggctcctcatcatgctgacatccaccgacgggccactggtaactcccgagtccaggttccagtggacaggttgggtctgggggacctaggtacgttcagtttcctacaccctatacacggtcacgaccctgacaggtcttaggaaattattttagacttaaattttattacgttagtcctaggtactaagttaaactaaagttaacgtgggtaggtaacgttacgggacccgtaaaaggggaacctaaagggttaaacgaaaactaaccgaaaacgtaacgtaggtaacgggctacgacctacagttcctagtacctttac

SEQ ID NO: 443081 - DNA, 840 bp, Homo sapiens
  misc_feature: GZ8MTXP02FPRJU.2.7.A07.1.454.CMB.2.raw
  modified_base (303)..(303): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagagcccaccctctcctgcagggccagtcagagtattagcagacaacttacgcctaggtaccagacaagaaacccgtggaccctagggccctacccaggccttcccnctatcctagtcgctagacccatcccaaccgacggggaccctacgtacggtacctccccgaaggtccgagggtttccaaggttcgggactagggtcggggttacgtagggggacctagggtaacgtttaccacgtttaccacccaaacgtaacttaccgaacggtacccaacgggccccttaggaccccgtaaaggttacccgttaagggttaaaagtttaactttttacggtaaacttttaaaacttttttaacgttaaccgtttacggtaaccttaaagggtaacttaaaaggtttaaaacttaaaaggtttaaccggtttaggggttaacggggtaaacccgggttttaccgggggaaaacccggtaaaaacggggttaaaacccggtaaaaaggggttaaaacgtaaaaaaaccgttaaaccgggaaaaaaacccggttaacggttaacgggtttaaccgggggaaccgttaacccggtaaacccgttaacccgtaaacgtttaccggttaaccgtttaccgttttaaaccccg

SEQ ID NO: 443082 - DNA, 656 bp, Homo sapiens
  misc_feature: GZ8MTXP02GI454.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaagcgccaccctctcctgcagggccagtcagagtattagcagctaacttagcctggtaccagtcaacgaaacctggaccaggcctcccgaggcctcctcatctatcgctgccatcccaccgagggcccagtcggtactcccagtcctaaggttccgagtggctaggtcggggtactgggggaacagggttacgtttcaacgtttcacctaaccgtatcccaggccgaacgtccgtacggtacctagggtttacctagggtaaacgttatttttacggacctttaaaagtttttcttacccgtttagcctaaaagtacctaaagttaaactaagttaaacgttggggtacggttaaccggttacgggacctaaaacgggggtaacctaaaggggttaaacaaaactttacgaaaaccgtaaacggtgtaggaaccttagactacgactttcgtacgttctttac

SEQ ID NO: 443083 - DNA, 707 bp, Homo sapiens
  misc_feature: GZ8MTXP02F0V3G.2.7.A07.1.454.CMB.2.raw
  modified_base (199)..(199): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagcccaccctgtctgtcgtctccgaaggggaaancgcccaccctctcctgcgagggccagtcagagtattagcagctaacttagccgtaggtaccagacaacgaaacccgtggaccacgggccctacccgacggcctccctacatctactcgtcctcgaccactccccaaccggaacggggtcccctaacgttcggtacctccccgaaggtcccgtaacgggttccaggttcgggccgtagggttcggggtacgtgggggacaggttacgttcctactttccgaccaaccatcacgcacgctcgactagtactagtaagttattacgtattaagtttacttacgtagtactagtataaagttaactaaacgttaggttcgggtaggtaaccgggttaccgggaaaccgtaaacgggggtaaaccgtaaaagggtaaaacgtaaaaacgttaaaccgaaaacgggttaaacgttgggtaaccggtaacggtaaccgtaacccgtaaccgtaacgtttccgttaaccggtttacctttaacccg

SEQ ID NO: 443084 - DNA, 838 bp, Homo sapiens
  misc_feature: GZ8MTXP02IA6H4.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctcgaggggaaancgccacctctcctgcgagggccagtcagtagtattagcagactaacttagcctggtaccagcaagaaaccgtggaccaggccctcccgaggtcctcctacattcctagtcgcctcgaccctacgtaccccgaaccgacggggtacccctaagttcgggtaaaccttcccccgaggtaccccgtaggggtttaccgacgggtggaccgttaggggttcggggttaccgtgggggtaacctaaggttaccggttttacctaacgttttacccacgttaaacccccaagtttaccgaaccggttaccgaaaccgggtccccttaacggtaccgttaacgggtttccgttaaaagggtaaaccgtttttaagtttttaccggtaaaacctttttaaaattttttttaaccggttaacccgttttagggttaacctaaagggtttaccttaaaagggtttaaaatttaaaacccgggtttaaggtacgggggtttacggtaaacccggggttttacccgggaaaacccgggtaaaaggggttaaacccgtaaaaaggggtaaacggtaaaaccttaaacgaaaaaccggtagtttcgggacggtaactacggaaccctacgtacgttcttacggtttaccttaccg

SEQ ID NO: 443085 - DNA, 820 bp, Homo sapiens
  misc_feature: GZ8MTXP02HPAYN.2.7.A07.1.454.CMB.2.raw
  modified_base (196)..(196): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcgacgggccagtcagagtattagcagactaacgttacgccgtacggtaccagacaacgaaccgtggccgacggcctcccgacggtccctccgtacacttctagtcgactcgacctaccgtaccccgaccggacgggtacccctacgttccgggtaaccttccccgaaacggtaccccgtagggtttacccgagggtcgggtaccggtaggggtttcggggtccggtacgggggtaaccgtaaacggggttactttaccgttaacgtttcccaacccgttaaaccgaccttacggaaaccggtaccgtaaccggtcccgttcgtaccgtacggttaaccgttaagggttaaacgtttacgttttaacgtaaacttttaaactttttaacgtttaaccgttcggttaactaccgggttaattaaagtttaaaagttaaacggttaaacgggttcggggttaaacggggtttaccgggtacgggtaaaaccccggggaaaggggttaaaacccgggttaaaagtaaacggtaaaacgtaaacgtaaaacggtacgttcgggtacggtaacggtactacggtaccctagtttacctcggtttacttaaccccg

SEQ ID NO: 443086 - DNA, 781 bp, Homo sapiens
  misc_feature: GZ8MTXP02FRE9T.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtattagcagctaagttcgcctggtaaccagaccaacggaaaccgtcggaccacgggtccctaccccgagggtccctaccctacacttacctagtcgtactcgcctactccccgaaccgacggggccctaaccgtacgggtaacctccccgtaacggtcccgtaacgggtttaccgaagggtcgggtaccgtaggggttccggggttacgtcgggggtaactaagggtaacgtttccgtaacgtttcctacccgtaaaccgtaacttaccgaacgacccgtaacgcccgttaacgacctacggtttaccgttaaggtaaaaggtttagttttacggtaaacttttaaactttttaaacttacgtttaccgttacgaacggtaaccttaacggttaaattaagttaacggttacggggttacggttaacgggtttacccggggaacgtaaaacggggtaacccgtaaaagggtaaaagtaaaaccgtaacgaaaacggttaacgtacgttacggaaccgtacgtacctacgttacttctacgttacctttaaccg

SEQ ID NO: 443087 - DNA, 745 bp, Homo sapiens
  misc_feature: GZ8MTXP02HG6DO.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctaccgaggggaaancgccccacctctcctgcgacgggccagtcaagtagttatagcagacaacttagcctggaccagacgaagaaccgtggcctacggcctacccgacggtcctcctacgattctattcgcctgacctactcccaaccggtacgggccacgttcggtacctaccccgagtacccgtagggttccaggtcgggacgtagggttcggggtacgtgggggaacctaagggtctttacgtaactttccaaccgtacctaactccgaacgccgaacgtcccgaggaccgtagttaccgttaggtaaagttacttttacgaaactttaagtttttaacttaccgttagtaggtaaccttaataaaggttaaacttaaagttaaacggttggggttaaaccgggttaaccgggtttaacgggaaaccggttaaaaacgggggaacccgtttaaaaggggaaaacggttaaaaaccaaaccgggtaaaaacgtacggtaggttaacgggaaccttacggaccctaaaacggttcgttacttacggtttacctttaccgg

SEQ ID NO: 443088 - DNA, 679 bp, Homo sapiens
  misc_feature: GZ8MTXP02J16WK.2.7.A07.1.454.CMB.2.raw
  modified_base (197)..(197): a, c, t, g, unknown or other
  modified_base (298)..(298): a, c, t, g, unknown or other
  modified_base (348)..(348): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaanacgcccaccctctcctgcagggccagtcagagttatagcagactaacttacgcctggtaccaggcaagaaacctggaccaggcctcccgaggtcctcctanatctatcgactgacctacaccccgaccgacgggccctaagtcggttaccncccgacgtcctaggttacgaggtggccgtagggtcgtaggtcgggacagggtacttcactttcaccacacgtacgagtccacgtctgggactacggtacgttaaggtaagtttactttaccgaaatttttaaattttcggtaactttccgaaagttagggtaccgttaaaattacccgtttaaaaggacccggtttggggtaaccgttaccggttaaacggggaccgttaaaacgggggaaactttaaaggggaaaccaaaacggttaaccgaaacgtagttacgggacaacgttaacgcctaaacggtcttaccgttcgttaacttcccg

SEQ ID NO: 443089 - DNA, 565 bp, Homo sapiens
  misc_feature: GZ8MTXP02G3H7H.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttgcctggtaccagcagaaacctggccaggcctcccaggctcctcatctatgctgcatccaccgagggcccagtcggtactcccgaagcctacggttcagtcggctaggtgggtctgggggactaggtacgttccagtttccacgactatcagcacgcctagcagtctacggtaagttatttagacttaaattttattactagtcaaggtctaagtataaacgtagtggtagtacggttcggacgtaaacgggactaaaggtaacgaaaagtaacgtaaacgaacgtggtacggctagaccgtaactattcgtaacgttctttaccg

SEQ ID NO: 443090 - DNA, 596 bp, Homo sapiens
  misc_feature: GZ8MTXP02J0CT1.2.7.A07.1.454.CMB.2.raw
  modified_base (198)..(198): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctaccgaggggaaanagcccaccctctcctgcagggccagtcagagtatagcagcaacttagcctggtaccagcaagaaacctggaccaggctcccaggcctcctcatctatgctgcatccaccgagggcccacgtcggtactcccgagcctagggttcaggtgacgtagggttcggggtctcgggggaactaggtacgtttactagttccttaccacccgtatacagcagccctgctaggtctagtaagttactttgacttaatttattacgtagtactaagtcaagttaattaaagtaacgttgggtacggtacgtttacgggaacccgtaaagggtaccgtaaagggtaacgtaaaactagaaaacgtaacgtgtacggctaacgacgactactcgtttagtccttaccg

SEQ ID NO: 443091 - DNA, 568 bp, Homo sapiens
  misc_feature: GZ8MTXP02IAQU0.2.7.A07.1.454.CMB.2.raw
  modified_base (195)..(195): a, c, t, g, unknown or other
  modified_base (368)..(368): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctcaggggaaangccacctctcctgcagggccagtcagagtattagcagcaacttagcctggtaccagcagaaacctggccaggcctccaggcctcctcatctatgctgcatccaccagggccatggtactcccagccaggttcaggtgcaggttgggtctggggacaggtacgtttcatttccncacccatcagtcagccctgcagtctagaagttatttgacttaaattttatacgttgtactagtactaagttaataaagttacgtggttaggtacgtttacggacccgtaaaagggtaccgaaagggtaactaaaacgtaacgaaaacgtaacgttggtaggtcgtacgactaacctagttccgtttacgtacctttaccg

SEQ ID NO: 443092 - DNA, 694 bp, Homo sapiens
  misc_feature: GZ8MTXP02HD6CU.2.7.A07.1.454.CMB.2.raw
  modified_base (202)..(202): a, c, t, g, unknown or other
  modified_base (380)..(380): a, c, t, g, unknown or other
  modified_base (657)..(657): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagcccaccctgtctgtgtcctaccgaaggggaaancgcccaccctctcctgcgacgggccagtcgagtagtattagacagactaacgttcgccgtaggtaccagacaacgaacccgtggccgagcctcccgagtcctaccgtcagttctagtcgctcgacacctaccgaccggacggacctagtaccggtaccaccgacggtcgaggttaccnggtcgacgttacggtgggtacgtgggaacgtaggttacgttactacgttcacctaaccagtaccgacgacgaccgtcgtagtacccgttagtacgttaggttaaaacgtttgtttaaccgtaaattttaacggttttaactacgtttcgtaaacgtggtttaaactaagtttaaacttaacgttaacgggtcggttacgtaccgggttacgaaacccgggtaaagtaaccggtaaaggtaaacaaaccgtaaacgtaaaacggtcggtgtaaccggngtaaccaactcgttaaagtcctacgttcctttaaccg

SEQ ID NO: 443093 - DNA, 740 bp, Homo sapiens
  misc_feature: GZ8MTXP02JARPA.2.7.A07.1.454.CMB.2.raw
  modified_base (397)..(397): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtcctccgaaggggaagcgcccaccctctcctgcgacgggccagtcagagtattagcagactaacttagccgtaggtaccagcaaacgaaccgtggccacggcctacccgaggcctcctcactctatcgctgcctactcccgaccgacgggaccctacgtcggtacctccccgaaggtccgtacggttccgaggtcggcgtagggtcggggtacngggggactaggtacgttcctagtttcccaccgtaactactccgaaacgtccgaacgtcccgttaggacttacgggtactaagggttaaattacgtttaccggtaaactttaaattttacttacgtcgtaacgtacgtaacttaaacggttaaattaaacggttacgggttaacggggttacgggttaacccgggttacggaaacccggggtaaaaggggttaacccggtaaaagggttaaaccgtaaaacgttaaaccgggaaaacggtaacggtttcggggaaaccggtaacggttaaccgacccgttaaacctgttacccggtttacctacctttaacccg

SEQ ID NO: 443094 - DNA, 769 bp, Homo sapiens
  misc_feature: GZ8MTXP02IB0OF.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagcgccaccctctcctgcacgggccagtcagagtatagcagactaacttagcctggaccagacaagaaacctggaccacggcctacccgaggccctcctacatccgtagtcgcctgacctactaccccgaaccgaggggacccctagttcggtaacctccccgaaggcccgtaagggttccgaaggttcgggacgtagggttcggggtccgtgggggaactaaggtacgtttacctaacgtttcccacctaaccctacgttaccgaacggtcccaacggtccccgttagggacccttaaaggttccgttaaagggtaaaccggtttatttttacggaaaaccttttaaagtttttaacttaaccgtttgaaccgtaacgtacgttaaaggttaaattaaaacgtttaacggttggggttaccggtaaccgggtttaccgggaaacccggtaaaaggggtaaacccgttaaagggtaaaataaaaccggtaaacgtaaaaaccggttacgttaggtacggtaaccgttacggaaccctaaccgttacgtttcctttacggtttaacccttaccg

SEQ ID NO: 443095 - DNA, 732 bp, Homo sapiens
  misc_feature: GZ8MTXP02JH07S.2.7.A07.1.454.CMB.2.raw
  modified_base (296)..(296): a, c, t, g, unknown or other
  modified_base (554)..(554): a, c, t, g, unknown or other
tcagacgctcgacacacgaccggtgctcgatttagcacgtgtcgcgagggggaggaactgctcagttaggacccagacggaaccatggaagccccagcgcagcttctcttcctcctgctactctggctcccagatgccactggagaagtggtgatgacgcagtcctccagccaccctgtctgtgtctccgaggggaaagcgcccaccctctcctgcagggccagtcgagagtattagcagctaacttgcctggtaccagacaagaacctggaccacggcctcccgaggcctcctanatctatcgctgacctactaccccacgacgggtccacgttcggtacctcccgaacgtccgtaacggttaccaggttggaccgtaaggggttcggggcgttaggggggaaccctaaggttaaccggttcctaaacgttttccctaccgaacccctaattacccggaaacggtacccgaacgtcccttaggtaccgagggtttacctagggttaaagttactttttaccggaaacttttaaagtttttacctttaacggtntaaccgtagtaacctaaaggttttaaacttaaacgttaaccgggttggttaaccgggtacggttaacggaacccggtaaaaagggggtaccctaaaagggggtaaacaaaacgttacgaaaaccggtagttacgtacggtaacgtacgaaccacttagtaccgttcttacctttaacc

SEQ ID NO: 443096 - DNA, 794 bp, Homo sapiens
  misc_feature: GZ8MTXP02II7UV.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagacgcccaccctctctgcgagggccagtcgagtagtattagcagactaacgttcgcctaggtaccagactaacgaaaccgtggaccaggcctacccgacggcctcctacagtctaagtcgctgacctactccccgacgacgggacctacgtaggtacctcccgagtccgttaaccggttacgaggttcggacgtaggggtttcggggtacgtagggggaactagggtacgtttaccgtactttcgtaccctaaaccgtacttaccgaaccgaccgtaacgtcccgttagtaccgttacgggtttaactaacgggtttaagttacgtttttaacgtaaacgttttaaatttttaaccgtttacgtttaacgttactaacggttaaccttaaagttaaagtttaaaccggttaaagggttacgggggttaaacgggttaccgggtttacccggggaaaaccggttaacggggtaaaacccggttaaaaggggtaaaacttaaaaacggttaaaacccgaaaacggttaccgttaagggaccggttaaccgtaccgaaccgttccgtaaaacgtttccggtttaactttaaccgtttacccg

SEQ ID NO: 443097 - DNA, 748 bp, Homo sapiens
  misc_feature: GZ8MTXP02GLPJ3.2.7.A07.1.454.CMB.2.raw
  modified_base (200)..(200): a, c, t, g, unknown or other
  modified_base (422)..(422): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtcctaccgaaggggaanacgcccacccgtctcctgcgacgggccagtcagtagtattagacagcaacgttacgccgtggtaaccaggaccaagaaacccgtggacccacggccctaccccgaggtccctccctactattacctagttcggccttcgacctactaccccgaaccgacgggccctaacgttcggtacctccccgagtccgtacggttcgaggttggcgtagggtcggttgnggggtacaggtacgtttctaacgttcctacaccgtctacgacggtcaacgtcccgtgacgtaacgttcgtaaagggttaatttacgttttagaacttttaaacgttttactttcgttacgtacgtaaggtaacttaaagttaaagtttaacggttaaacggttcggggttaaacgggttacccggttaacccggggaaccggtaaaacggggtaaacgtaaacggggtttaaaaacaaccggtttaaaacgaaaaccggttacgtaggtaccggtaatacccggaaactacccgttaatccgtttacggtttacctttaaccccgg

SEQ ID NO: 443098 - DNA, 694 bp, Homo sapiens
  misc_feature: GZ8MTXP02GY5O9.2.7.A07.1.454.CMB.2.raw
  modified_base (198)..(198): a, c, t, g, unknown or other
  modified_base (258)..(258): a, c, t, g, unknown or other
  modified_base (274)..(274): a, c, t, g, unknown or other
  modified_base (285)..(285): a, c, t, g, unknown or other
  modified_base (289)..(289): a, c, t, g, unknown or other
  modified_base (291)..(292): a, c, t, g, unknown or other
  modified_base (296)..(296): a, c, t, g, unknown or other
  modified_base (300)..(300): a, c, t, g, unknown or other
  modified_base (322)..(322): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgccaccctctcctgcgagggcccagtcaggagtatagcagcaacttgccgtaggaccgnaagaacctgccaggcnccgagctaccntatntnnctcncacnccgacgcggcctagtcgtaccncgacgacgtaggtaccgaggtcggacggtacggtcggggtacgtacgggagtacggttacgttcctacgttcctactaacctactacgacgaccgtacgtccgtagtacgtacgtacgtaagttaaacgtttacgtttaacgttaactttaaactttacgttaacgttaggttaacgtagttaaacgttaaagttaaactttaaacgtaacgggttacggggttaacgggtaaccgggttaaccgggaaaacgggtaaaacgggtaaaccggttaaaagggtaaacgtaaaacggtaaacgtaaaacgggttacggtacgggtacgtacgtaacgtaaccgtactacgttactacgtttacctacctaaccg

SEQ ID NO: 443099 - DNA, 582 bp, Homo sapiens
  misc_feature: GZ8MTXP02FHFAQ.2.7.A07.1.454.CMB.2.raw
  modified_base (196)..(196): a, c, t, g, unknown or other
  modified_base (300)..(300): a, c, t, g, unknown or other
  modified_base (329)..(329): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgagggaaanacgccaccctctcctgcagggccagtcagagtattagcagctaacttgcctaggtaccagcaagaaacctggaccaggcctcccaggcctcctcatctatgctncactcccaccgagggcccagttcggtacncccagccgtaggttccaggtcggctaggtcggggtctggggactaggtacgttcatttcacacctatcagccatcctgccagtctagaagtattttgacttaaatttattacctgtctaggctaagtataagtaacgtggtcggtacgttcggaacaaacggggtacctaaaggggtaaactaaaacgtacgaaaaaccgtactgggttacgaacgtacgaccctacaacgtttcgtaccgtttcttaacccg

SEQ ID NO: 443100 - DNA, 587 bp, Homo sapiens
  misc_feature: GZ8MTXP02J14P5.2.7.A07.1.454.CMB.2.raw
  modified_base (378)..(378): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgcccaccctctcctgcagggccagtcagagtattagcagcaacttagcctggtaccagcagaaacctggccaggcctcccgaggcctcctcatctatgctgcactcccaccgagggcccatcggtactccccagtcctacggttcagtggctagtcggggtctgggggactaggtgttnactttaccgacacccattcgaacgcgacgccctgcgtacgttctagtaagttattttgactttaaatttctaacttgtacagtactaagttaactaaattaccggttaggtacgggtacgttacgggaccgtaaaaggggacccgtaaaggtaaagaaacttacgaaaaccgtactaggtacggctcggacacgtatctacgtacttcg

SEQ ID NO: 443101 - DNA, 620 bp, Homo sapiens
  misc_feature: GZ8MTXP02F3WTH.2.7.A07.1.454.CMB.2.raw
  modified_base (362)..(362): a, c, t, g, unknown or other
  modified_base (426)..(426): a, c, t, g, unknown or other
  modified_base (464)..(464): a, c, t, g, unknown or other
  modified_base (548)..(548): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagacgccaccctctcctgcacgggccagtcagagtattagcagacaacttacgcctaggtaccagacaacgaaaccgtggaccacggcctaccccgaggcctcctcatcctatcgctcgcactcccaccgacgggccacgtcggtacctccagaccgtaaggtacgngcgtaggtggtcgtagggcgtagtgttactacttccgtacacgatcgagcagcctgcgtacgtntaggtaatttatttacactttaaatttattactggtanacgtagtaaataagttaaacgtaggttacgggttaggtaccggttacgaaccggtaaaggggtaaacctaaaaggggttaaaanaaaaccgtaaacgaaacggttacgtaggtacgacgtaacgacctacgtacttcgttacttaccttacgtacc

SEQ ID NO: 443102 - DNA, 753 bp, Homo sapiens
  misc_feature: GZ8MTXP02FGP6E.2.7.A07.1.454.CMB.2.raw
  modified_base (196)..(196): a, c, t, g, unknown or other
  modified_base (208)..(208): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaanacgcccaccctntcctgcagggccagtcagagttatagcagctaaacttagcctggtaccagctaagaaacctggccaggcctcccaggtcctcctcagtctatgctgcactcccaaccgaggggtcccaacttgggtaacctcccgaaagtcccgtaaggggtttccaaggggtcggacgtagggttcggggtccgttgggggtaaccaggttaagtttccaattttcccgtacaaccctattaccgaacggacaacggtcccttgaccgtaagttacgtaggtaaagttatttttacggaaaccttaaattttaactttaaccgtggtttacccaagggtacctaaaggttaaacttaaaaagttaaaaccgggttgggggttaaggttaaaccgggtttacccgggggaaaaccccgttaaaacggggggaaacccctaaaaagggggttaaaacgaaaaaacttacggaaaaaaaccggttaacgttaacgggtacggggccgttacgtaaacccgtaccgaaactttcccggtaagtttccctttaaacccg

SEQ ID NO: 443103 - DNA, 740 bp, Homo sapiens
  misc_feature: GZ8MTXP02IANU6.2.7.A07.1.454.CMB.2.raw
  modified_base (199)..(199): a, c, t, g, unknown or other
  modified_base (267)..(267): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctcgaagggggaaancgcccacctctcctgcagggccagtcagagtatagcagcaattgcctggacagcagaactgccagccnccagctcctcatctatgctgcctactcccacgacggggccctacgtcgggtaacctccccgaacggtcccgtaaggggtttcccaagggttcgggaccgtagggttcggggttccgtgggggaacctaggtacgtttcagtttccaccaaccctaatcacggtaccacgtccgtagacgttaggttacgtaaggtaaacgtttcgttttaacgtaaacttttaaatttttaacgttaccgtttagtaaccgtaaggttaaccgttaaaagtttaaaacgtttaaacggtttaaacgggttcgggggttaaaccggggttaacccgggttaacccggggtaaaaccggtaaaacgggggtaaaaccgttaaaaaggggttaaactaaaacgtaaaccggtaaaaacgtacggttacgggtacggtaaccgaaccgtaaccgtaaccgttagtttccggttacgtttaccctacg

SEQ ID NO: 443104 - DNA, 540 bp, Homo sapiens
  misc_feature: GZ8MTXP02FKX5Z.2.7.A07.1.454.CMB.2.raw
  modified_base (196)..(196): a, c, t, g, unknown or other
  modified_base (319)..(319): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggcctcctcatctatgctgcatccaccagggccacgtggtacncccagccaggttcaggtggcaggtggggtctgggggacaggtagttcatttccgtcacccatcagcagcctgcagtctagaatatttgacttaaatttattactgtcagctaagttataaatacgtggtggtacgttcggaccgaaacgggaccgaaaggtaacgaaaagtacgaaaacgtaactggtagcgtacgaccgacctatctacgtactttaccg

SEQ ID NO: 443105 - DNA, 659 bp, Homo sapiens
  misc_feature: GZ8MTXP02JHMPC.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagtaagtggtgatgacgcagtctccagccaccctgtctgtgtctccgaggggaaagcgcccaccctctcctgcagggccagtcagagtatagcagctaacttagcctggtaccagacaacgaaaccgtggaccaggcctacccgaggcctcctcatctatcgctgacctactcccaaccggacgggccctacgtcggtactccccgagtacccgtaagggtttccagggtcggaccttaggggtcggggttacgtgggggaacctaggtaacggtttccaagtttcccaccacctataccgaaggccaagtccctaggactacgtcgtaagtaaagttattttcgaactttaaatttacttacgtgtacaagtataaagttaataaacgttacggtgggttacgggtaaccgttaccgggaacccggtaaaaggggtaccgtaaaaaggggttacaaaaagtaaccgtaaaacgtacgtggaacgtctacgactaccgtattcgtactaccttaacg

SEQ ID NO: 443106 - DNA, 601 bp, Homo sapiens
  misc_feature: GZ8MTXP02H9YXK.2.7.A07.1.454.CMB.2.raw
  modified_base (197)..(197): a, c, t, g, unknown or other
  modified_base (286)..(286): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtgtctccgaggggaancgccacctctcctgcagggccagtcagagtatagcagcaacttgcctggtaccagcaagaacctggccaggcctcccgaggtcctcctnatctatgctgacctactccaccgagggccctaggtcggtaacctccccgaaggtccgtaacggttcacgggtcggtacgtagggttcgggtcgtgggggactaggtacgttcacgtttccaccgacactcgacgtcacggcctgctacgtcgtagtaaagttctttgaaactttaagtttatacgttgtacctaagtactaaagttataagttacgtggtacgtacgtacgacgtaaggaccgtaaaggtaacgaaatacgaaacgtaacgttgaacggtctacggacctacgtagtacgttcgttaccttaccg

SEQ ID NO: 443107 - DNA, 644 bp, Homo sapiens
  misc_feature: GZ8MTXP02JMMG7.2.7.A07.1.454.CMB.2.raw
  modified_base (385)..(385): a, c, t, g, unknown or other
  modified_base (495)..(495): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaacacgcccaccctctcctgccgagggccagtcaagagtatagcagctaacttgcctgtaccagcaagaacctggaccaggcctacccgaggtcctcctcatcctatcgctgcctactcccgaccgacggcctaacgtcggtaacctccgacgtacccgtaggttccaggtcggacgtagggttgggtcgngggggactaggtacgttacacgtttccaccacctagtaccgaacgacgtacgtccgtacgtacacggttactaagtaaagttctttagtaactttaaatttactacgttntacgtagtataaagttactaagttaggtacggtacggtaccgtacggaaaccggtaaacggaacggtaaaggaaacgtaaagtaaccgtaaaacggtacgttagtacgtaacgtacgtaccgtaactcgtttacttacgttaccttccg

SEQ ID NO: 443108 - DNA, 693 bp, Homo sapiens
  misc_feature: GZ8MTXP02GPKG6.2.7.A07.1.454.CMB.2.raw
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaagcgcccaccctctcctgcgagggccagtcagagtatagcagactaacttagcctggaccagcaagaacctggccaggcctcccgaggcctcctcatctatgctgccactcccgaccgacgggccctacgtcggtactaccccgaggtcctacggggtttcaggtcgggacgtaggggttcggggtcgttcgggggaactagggtacgtttacctaactttcccaacccacctaaacgttccgaaacggtcccaacggtcccgttacgaccgtacggttaccgtaggtaaagtttacgttttagaaaccttttaaagttttacttaccgttaggtacctaggtactaaagttaaacgtaaagtttaccggtgggtacgttaaccgggttacggaaacccggtaaaacggggtaaccgtaaaaggtaaacgtaaaacgaacgtaaaaccgtacgtggtacggaactacggaactacctattccgtacgttaccttaccg

SEQ ID NO: 443109 - DNA, 626 bp, Homo sapiens
  misc_feature: GZ8MTXP02IQGRV.2.7.A07.1.454.CMB.2.raw
  modified_base (252)..(252): a, c, t, g, unknown or other
  modified_base (282)..(282): a, c, t, g, unknown or other
  modified_base (292)..(292): a, c, t, g, unknown or other
  modified_base (296)..(296): a, c, t, g, unknown or other
  modified_base (337)..(337): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccacctctcctgcagggccagtcagagtattagcagcaattagcctaggtaccngcaagaacctggccaggctcccgagctccncatcatgctnccanccccacgagggcccatggtacctcccgagtcccaaggttcnggtggctaggtgggctggggacagggtattcgactttcaccactgacaggtcagcctgacgagttactaggtaattagttttacgattaaaatttttattaaacgttcgttaccaaggtaacctaaaggtttaaacgtaaaatttaaaccggttaggggttacggttaaaccggttccgggaacccgttaaaagggggaccccgtaaaagggttaacgaaaaaacgttaccaaaaacggttaaacgttcgtaacgggctagacctacctaattccgttcctactttacc

SEQ ID NO: 443110 - DNA, 639 bp, Homo sapiens
  misc_feature: GZ8MTXP02GATOQ.2.7.A07.1.454.CMB.2.raw
  modified_base (198)..(198): a, c, t, g, unknown or other
  modified_base (411)..(411): a, c, t, g, unknown or other
  modified_base (421)..(421): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctggcaggccagtcagagtattagcagcaaacttgctggtaaccagacagaacctggaccaggcctcccaggctcctcagtctatcgctgaccatcccgaacgacgggtaccctacgtcggtaacctccgagtcccgaaggtttccaaggtcggtaccgaggttcgggtacgtgggggacctaggtacgttacacgtttnaccaacctanacacgacgacgtcgtagacgtagtagtagaagttagttataactttaatttacgtacgtacgttacacgtactaaagttaagtaaacgttaacggtacgggtaacggtaacggttacggaaaccgtaacgggtaaacgtaaaacggtaaagtaaaacgacgaaaacgtaacgtacggtacgtaacgtacacctaacgtacttacgtacgtttactacg

SEQ ID NO: 443111 - DNA, 674 bp, Homo sapiens
  misc_feature: GZ8MTXP02I16G5.2.7.A07.1.454.CMB.2.raw
  modified_base (197)..(197): a, c, t, g, unknown or other
  modified_base (649)..(649): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccacctctcctgcgagggccagtcagtagtattagcagctaagttcgccgtggtaacccagtacaacgaaacctcggccaggcctacccgaggtcctcctcagttctatcgcctgacctactcccgaaccgacgggaccctacgttcggtacctccccgaagtccgtaacggttccaggttcggaccttagggtcgggtacgtcgggggaactacggtacggttaccacggtttacccgtacccaaacgtcgttaacgaccgaccgacgtcccgttagacttacgttaccgtagtaaaccgtttagtttcgaaaccttttaaattttattaaccgttggtacctaagtaccgttaaaggttaaataacggttacgttaggggtacgtaccggtacggaacgaaaacgggtacgtaaaggtaaacaaacgttacgaaacgaagtgtacggngactacacgcttactcgtactttac

SEQ ID NO: 443112 - DNA, 625 bp, Homo sapiens
  misc_feature: GZ8MTXP02JXCJL.2.7.A07.1.454.CMB.2.raw
  modified_base (199)..(199): a, c, t, g, unknown or other
  modified_base (256)..(256): a, c, t, g, unknown or other
  modified_base (274)..(274): a, c, t, g, unknown or other
  modified_base (285)..(285): a, c, t, g, unknown or other
  modified_base (445)..(445): a, c, t, g, unknown or other
  modified_base (471)..(471): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtcctccgaaggggaaanacgcccaccctctcctgcagggccagtcagagtatagcagcaacttgcctggtaccngcaagaacctgccagccnccagcctcctnatctatgctgcactccaccgcgggaccacgtcggtacctaccccgagtaccgtaggttccgagggtcggaccgttagggtcggggtcgtcgggggactaggtacgttaccatttccacacctactccacgctacggtcctagctacgtcgtagtaagttnttagactttaatttactacgtcgtanacgtactaagttaaactaagttacgtcgggttacggtaccggtaccggaacggtaacgggaaaccgtaaagggtaaacctaaaagtaaccgtaaaacggtaacgttggtaccgaacgttacgacctacgtacgttccgttacgtcctttaaccg

SEQ ID NO: 443113 - DNA, 654 bp, Homo sapiens
  misc_feature: GZ8MTXP02HX0E6.2.7.A07.1.454.CMB.2.raw
  modified_base (199)..(199): a, c, t, g, unknown or other
  modified_base (213)..(213): a, c, t, g, unknown or other
  modified_base (437)..(437): a, c, t, g, unknown or other
  modified_base (442)..(442): a, c, t, g, unknown or other
  modified_base (462)..(462): a, c, t, g, unknown or other
  modified_base (500)..(500): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggcctcccagatgccactggagaagtggtgatgacgcagtctccagccaccctgtctgtcgtctccgaaggggaancgccaccctctccngcgacgggccagtcaagtagtagttagcagactaacttacgcctaggtaccagacaacgaaaccgtggaccaggtccctcccgacggtcctcctactactctagtcgctcgacactccccaacggcgggtccacggttacggaaccttccccggagtcccggtaaggttcgacggtggtacgtgggttcgggcgtgggggacctagtacgttctactttcccanaaccntgacgctcgctgactacgtntagtaaccttgtttacactttaaagtttacttacgttntacgtagtacttaaagtaagttaacgttacggtcggttacgggtaaccgttacggaacggtaaaacggtaacggtaaaagtaaacgtaaacgaacggtaaacgttacgtacgtacgtaacgacgtaacctacgttactttacttcgtttacctc

SEQ ID NO: 443114 - DNA, 631 bp, Homo sapiens
  misc_feature: GZ8MTXP02IX0NL.2.7.A07.1.454.CMB.2.raw
  modified_base (465)..(465): a, c, t, g, unknown or other
  modified_base (479)..(479): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaagagccaccctctcctgcacgggccagtcagagtattagcagctaacttagccgtaggtaacccaggacaagaaacctggccaggccctacccgacggtcctacccgtcattctatcgctcgccactcccacgacgggcctacgtcggtacctcccgagcctacggttcaggtggcgtaggttcgggtctgggggacaggttacgttctacttcgtaccactatacgacgtacacggtccttagactacgtcgtaagtaaagttattttanaactttaaattttntacgtgtactaaggtactaagttaattaaacgttaggttacggggttagtaccgggttacggaaccggtaaaagggggacctaaaaggggttaacaaaactaacgaaaacgtacgtggtaagccctagactaacgtattcgtactacttacc

SEQ ID NO: 443115 - DNA, 739 bp, Homo sapiens
  misc_feature: GZ8MTXP02IP4UA.2.7.A07.1.454.CMB.2.raw
  modified_base (196)..(196): a, c, t, g, unknown or other
  modified_base (433)..(433): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctccagatgccactggagaagtggtgatgacgcagtctccagccacctgtctgtgtctccgaaggggaaanacgccccaccctctcctgacgagggcctagtcaaggagtaattagcagacaagttgcctaggtacacgacaacgaaacctggaccgagcctaccgacggtcctccgtcagttcctatggctagcactcccgacgacgggacctaggtcgactcccgagcgtacggtcaaggtcggcgtaggtggtacgtcgggggataggtaccgttactaacgtttccaccgtaaacctagtaccncggaacttaccgggacctcgtacgtaacggtttccgtaaggtaaaacgtttacgttttacgaaaacctttttaaacttttaaagtttaacggttcttaaaacggaacgggtttaccgtaaacttaaaagtttaaaacccgttaagggtttacggggttaacggttaaccccgggtaacgggggtaaaccgaaaaccgggggtaaaccctaaaagggtaaaacgtaaaactaaacgtaaacgtaaacgttacggacggtaacctacggaacctaacctacgtttacccggtattacctttaacccgg

SEQ ID NO: 443116 - DNA, 763 bp, Homo sapiens
  misc_feature: GZ8MTXP02FSUCZ.2.7.A07.1.454.CMB.2.raw
  modified_base (197)..(197): a, c, t, g, unknown or other
tcagacgctcgacacacgaccggtgctcgatttagcacgtgtcgcagggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggctcccaggcctcctcatctatgctgcatcccgacacgggccacgtcggtactcccgagcctacggttccagtggcaggtcggggttctgggggaccaggtacgtttacgacgtttctaccgtaaccctacgttccaacggtacctaacggtcccgttagggaccctaggtttacccgttaaggggtaaaagtttacgtttttaactaaccggttttaaatttttaaacgtttaaccgtttcgggttaccctaagggtaacccttaaaagggtttaaacttaaaagtttaaaacggggttcggggtttacggggttaaacccgggtttaacccgggggaacccccggtaaaaacgggggtaaaccccgtaaaaagggggtttaaacgtaaaaaaccgttaaaccggaaaaacccggttaaaacggttccggttaacgggaaccgttacggaaccctaacccggtacgttaccttaccggtttacctttacccg

SEQ ID NO: 443117 - DNA, 513 bp, Homo sapiens
  misc_feature: GZ8MTXP01B6P91.44.1.A01.1.454.CMB.2.raw
  modified_base (349)..(349): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattgatatctggttggctggtatcagcagaaaccagggaatgcccctaaggtcctgatctataaggcgtctagtttagaaaggtggggtcccatcaaggttcagccggcagtggatcgtagggacngaaattcactctcaccatcagcagcctgcagcctgatgatttgactaattattactgaccaaatagtaataagagtttattctctagtacgttttggccgtaagggggaccaaaggcttagggaagattacgaaacgacgtgtaggctagcacctaattccttg

SEQ ID NO: 443118 - DNA, 503 bp, Homo sapiens
  misc_feature: GZ8MTXP01CD9PV.44.1.A01.1.454.CMB.2.raw
  modified_base (348)..(348): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattgatatctggttggcctggtatcagcagaaaccagggaatcgcccctaaggtcctgatctataaggcgtctagtttagaaagtgggtccatcaaggttcagccggcagtggatcgtagggacngaattcactctcacatcagcagcctgcagctgatgatttgactaacttattactgaccaaacagtaataaagtagttattactctagtagttttggccgtaaggggaccaaggcttggagattacgaaacgaactgtggctgcactaattcttcg

SEQ ID NO: 443119 - DNA, 491 bp, Homo sapiens
  misc_feature: GZ8MTXP01EE5UZ.44.1.A01.1.454.CMB.2.raw
  modified_base (485)..(485): a, c, t, g, unknown or other
  modified_base (491)..(491): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattgatatctggttggctggtatcagcagaaaccagggaatcgcccctaaggtcctgatctataggcgtctagttagaagtgggtccatcagtcagcgcagtggatcgtagggacaagtatcactctcaccatcagcagcctgcagcctgatgtatttgctaacttattacgtcgactaaactagtaataagatttatctcgtagttagtttggcgtaaggggaccaagcttaggacattacgaacgatgtggctgcaccttnttcgtn

SEQ ID NO: 443120 - DNA, 545 bp, Homo sapiens
  misc_feature: GZ8MTXP01BUUVY.44.1.A01.1.454.CMB.2.raw
  modified_base (361)..(361): a, c, t, g, unknown or other
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccagatcagtccaaccaaacctcctacatacaaagtactaccttcccccgtccatcctcgacggggtcccctgaggttcagtggcagtggatctgcgaacagtnttccaccctcacccatacaaatacgcctaggaagctagaagatgctgactaacgtattactgtacagtcagtagtagttacgttaccgtcggtctacgtttcggccgaggggtaccaaggtcgtaggagacttacgaaacgtacgttaggttcggctgccaactatcgttagtccttcgtaacc

SEQ ID NO: 443121 - DNA, 658 bp, Homo sapiens
  misc_feature: GZ8MTXP01EMKDU.44.1.A01.1.454.CMB.2.raw
tcagacagtatatacacgaccggtgctcgatttagacgtctcatcaggggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccggcagtcagagtattgatatcgtggttggctggtatcagacaaggaaaccgagggaactcgaccccgtaaggtccctagaacttctaagtaacggtcgttacgttaaggttttaaggaaagggttcgggggtaccccaagttaccgtaaaaggggtttccgaacgggtccccgggtacgtaaggtcgggtaattcccggtaagggggaaacctaaggtaaactttccaccttacctacaaccctatacacgcgacgcctggcacgtacctagtatagttagtttcgaacttaactttacttaactcgtaacctaaacgtagtaaataagttagtttattactagtagttacggttttacggaccggtaacggggtaaccaaggtcgttagggaagtaacttaacgaaacgttacgtggtggtaactcggaccttacctaagttcgttcg

SEQ ID NO: 443122 - DNA, 544 bp, Homo sapiens
  misc_feature: GZ8MTXP01BDUBY.44.1.A01.1.454.CMB.2.raw
tcagacagtatatacacgaccggtgctcgatttagacgtctcatcaggggggcatgagcaaaactgacaagtcaaggcaggaagatgttgccatcacaactcattgggtttctgctgctctgggttccagcctccaggggtgaattgtgctgactcagtctccagactttcagtctgtgactccaaaggagaaagtcaccgtcacctgccgggccagtcagagcattgctagtagcttacactggtcccagcaagaaaccagatcagtacaaccaaacctcctacatacaagtactacctccccgtcatctcgacgggtccctgagttcagtgcagtggatctgcgaacagtcttccaccctcaccatcaaatcgccgtaggaagcgtagaagagtagctagactaacgttacttactgtacagtactaggtagttacgttacgtttaccgtcggtacgttacgtttcggccgtacggggaccgaagcgtaggagacttacgaaacgtaacgttggttggctgcaactatcttcgttcttcgtc

SEQ ID NO: 443123 - DNA, 558 bp, Homo sapiens
  misc_feature: GZ8MTXP01EZKHT.44.1.A01.1.454.CMB.2.raw
  modified_base (344)..(344): a, c, t, g, unknown or other
  modified_base (435)..(435): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattgatatctggttggctggtatcagcagaaaccagggaatgcccctaaggtcctgatctataaggcgtctagtttagaaagtgggtccatcaggttcagcggcagtggatcgtagggacngaattcactctcaccatcagcagcctgcagcctgatgtatttgactaacttattactgaccaaactaagtaataaagtagttattaccgtntaggtagttttcgggaccgtaacgggggtaaccgaaagggtacgttaggggaagtaacgttaaccgaaaacggttaaccgttaagggtacgggtcttcggaccaaccctaagtttccctttcg

SEQ ID NO: 443124 - DNA, 557 bp, Homo sapiens
  misc_feature: GZ8MTXP01ALRFI.44.1.A01.1.454.CMB.2.raw
  modified_base (483)..(483): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattgatatctggttgctggtatcagcagaaaccagggaatcgacccctaaggtcctgatctaagtaaggcgtacgtaggtttagaaaggttcgggggtaccccagttaccgaaacgggtttcaacggcccggacgaagggttggaacttcgtaagggggaaccaaggtaaactttccacttcctacaccatcagcagcctggcagcctgatgattttgactacttattactcgactaacagttaataagtattaacttctntagtagtttcggcgaaggggaccaaggcgttggaagacttacgaaacgacgtgtaggctgacacctgttccttg

SEQ ID NO: 443125 - DNA, 652 bp, Homo sapiens
  misc_feature: GZ8MTXP01AFZ90.44.1.A01.1.454.CMB.2.raw
  modified_base (259)..(259): a, c, t, g, unknown or other
  modified_base (386)..(386): a, c, t, g, unknown or other
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaattgtgctgactcagtctccagactttcagtctgtgactaccaaaggagaaagtcaccgtcacctgccgggcagtcagagcattgctagtagcttacactggtcccagcagaaaccngactcagtacaacctaaacctcctacatacaaagttactaccttccccgtacactcctacgacggggttcccctcggtacggttcgagttggcctaggtggatcgtgacgaacagtcttccaccctnaccatacaatacgacctaggaagcgtagaaacgtgtacgctagactaaacgttattacgtcgttacagtacgtaaggtacgttacgttacgttaaccgttcggggtactttaacgttttcgggacccgtaaggggtaaccccaagggtccttaagggaaacgtaacgttaaaccgtaaaccggtaaacgttcggggttcggaccgtttaagggacccctaaaccggttcttacccgttcggtttaaccgtttaaccgttaaccccg

SEQ ID NO: 443126 - DNA, 542 bp, Homo sapiens
  misc_feature: GZ8MTXP01AIAQ4.44.1.A01.1.454.CMB.2.raw
  modified_base (351)..(351): a, c, t, g, unknown or other
  modified_base (369)..(369): a, c, t, g, unknown or other
  modified_base (382)..(382): a, c, t, g, unknown or other
  modified_base (388)..(388): a, c, t, g, unknown or other
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagacttttagtctgtgactccaaaggagaaagtcaccgtcacctgccggcagtcagagcattgctagtagcttacactggtcccagcaagaaaccagatcagtccaaccaaaccctcctacatcaaagtactaccctccccgtcatcctcgacggggtcccctggagttcagtggcagtgatctgcanaagtacttcaccctcacntacaatgcctgantgaagntgctgactaacgtattactgtcatcgaagtagttagtacgttacctcggtctacgtttcggaccgtaggggaccagtccgtaaggacgagtacgaaacgaacgttagttgggccttacggcacctaactctcgttacttcgttaactttccccg

SEQ ID NO: 443127 - DNA, 519 bp, Homo sapiens
  misc_feature: GZ8MTXP01EF98B.44.1.A01.1.454.CMB.2.raw
  modified_base (350)..(350): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattgatatctggttggcctggtatcagcagaaaccagggaatcgcccctaaggtcctgatctaataaggcgtactagtttagaaagtggggtaccatcaaggttcagcggcagtggatcgtagggacngaattcactctacacatcagcagcctgcagcctgatgtatttgactaaacttacttacgtagtaccaaactagtaataaagtagttaattctagtagtagtttggccgaagggtaccaggtcgttaggacgattacgaaacgttacgtgtgcgtgcactaattcgttcg

SEQ ID NO: 443128 - DNA, 631 bp, Homo sapiens
  misc_feature: GZ8MTXP01CG5XS.44.1.A01.1.454.CMB.2.raw
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtatgatatctggtgctggtatcagcagaaaccagggaatcgcccctaaggtcctggatctaagtaaggcgttacgttaaggtttaaggaaaagggttcgggggtacccctaagttaccgtaaaaggggtttccaagggtccccggggactaaggggttggggaacttccggtaagggggaaacctaaggtaaactttccaaacttcctaccaacccatcagcacggcctggcagcctagattgtatttgactaactttattactagtaccaaatagtaataagtagtttattctacgtaggttaggttttcggccgtaacgggggtaaccaaggtcgttagggaaacgtaagttaaccgaaaacggttaacgttgggtacggtctcggacttaccctaattccgtttaacg

SEQ ID NO: 443129 - DNA, 629 bp, Homo sapiens
  misc_feature: GZ8MTXP01CRWWL.44.1.A01.1.454.CMB.2.raw
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttggccggcagtcagagtatgatatcgtggtttttggcgtggtatcagacaagaaaccgagggaactcgaccccgtaagtcctagtatctagtaaggtcgttacgttaagtttaggtaaagggttcgggggtaccctagttacgaaaggtttcacggccggtcgaggtggaatcgtaagggacaagtaactcactctcacactcagcacgcctgcacgcctagtacttgtactttagacttaaactttacttaacctcgtaacctaaacgtaacgttaattaaagtacgtttactttacgtacgtaaggttagggtttaccggaccggtaaggggtaacccaaggtccggttaaggtaacgtaacgttaaccggttaaacgaaccgttggtacgggtctcggacacccgtaagttctttaaccg

SEQ ID NO: 443130 - DNA, 658 bp, Homo sapiens
  misc_feature: GZ8MTXP01CKHRG.44.1.A01.1.454.CMB.2.raw
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctcccttccaccctgtctgcatctgtaggagacagactcaccatcacgttcgccggccagtcagtagttatgatatcgtggttggctggtatcagcaagaaaccgaggatccgacccctaaggtcctgactactaagtaacggtcgttagttaaggtttaacggaaagggttcgggggtacccagttaccgtaaggttcaggcccggcgaaggttggatccgtaaggggaaccaagtaacttccacttcctaccaacctagtacagctacggcctgaccacggtcctagtattgttattttagaaccttaactttaacgtttacctacgtaaacccgtaaataaggttaaattaagtaacgtttaatttacctacgtagggttacgtttcgggacccgtaacgggggaaccaaaggtcgttaggggtaaacgtacgttaaaccgaaacggttacgttaaggtcgggtaacttacggacccttaccttaactttcgttccg

SEQ ID NO: 443131 - DNA, 595 bp, Homo sapiens
  misc_feature: GZ8MTXP01BT994.44.1.A01.1.454.CMB.2.raw
  modified_base (421)..(421): a, c, t, g, unknown or other
tcagacagtatatacacgaccggtgctcgatttagacgtctcatcaggggggtcagacccagtcaggacacagcatggacatggagggtccccgctcagctcctggggctcctgctgctctggctccaggtgccaaatgtgacatccagatgacccagtctccttcaccctgtctgcatctggtaggagacagagtcacatcacgttgccgggcagtcagagtattgatatcgtggttcggcctggtatcagcagaaccgagggactcgcccctaaggtcctgatctagtaacggtcgttactaggtttagaaacggttgggggtaccctagtcgaaaggttcacgggtccggacgtaggtacggagttcgtaaggggaacaaggtaacttcgaccttcgtacacctatccagcaggaccngacgacgtactagtatgttattcgaacttaactttacttacgtacgtaactaagtagttaaagtaacgttagttacttacgtagtaggtttacgttcggacggtaacgggtacaaggtcgaggaacgtaacgttacgaacgttacgtgtcgtcgtcgacttacgtcgttcgtcg

SEQ ID NO: 443132 - DNA, 524 bp, Homo sapiens
  misc_feature: GZ8MTXP01EKSBN.44.1.A01.1.454.CMB.2.raw
  modified_base (509)..(509): a, c, t, g, unknown or other
tcagacagtatatacacgaccggtgctcgatttagacgtctcatcaggggggcatgagcaaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccgtcacctgccgggccagtcagagcattgctagtagcttacactggtcccagcagaaaccagatcagtaccaaccaaacctcctcatcaaagtactaccttccccgtcatctcgacggggtcccctgaggttcagtgcagtggatctgcgaacagtctttcacccctcaccatacaaatacgcctggaagctgaagatgctgacaacgtattactgtcagtctagagttagttacgttaccgtcggtctacgtttcggccgacggggaccagctggagattacgaaacgacttgttggctgcaaccntcttgttcttctaac

SEQ ID NO: 443133 - DNA, 681 bp, Homo sapiens
  misc_feature: GZ8MTXP01AUYN2.44.1.A01.1.454.CMB.2.raw
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctcccttccaccctgtctgcatctgtaggagacagagtcaccatcacgttcgccggcagtcagtagtatgatatcgtggttggcgtggtatcgagacaagaaaccgaggtactcgaccccgtagtcctgatctaagtaaggtcgttattaaggttaggaaacggttcgggtaccctagtacgtaacggttcgacggccggcgtaggtggtactcggtaagggaactaagtacttccactctacacatacgacgcacgtccgtagaccacgtcgttagtacttaggttacttttacgaaccttaacctttaagttacctaacgtaacccgtaaaactaggtttaaacttaaaggttaactttacgtttaccgtaccgttaagggttttaccggtttaccggggaacccgggttaaacgggggaccttaaaggggtccgttagggaaaccgtaacgttaaaccgaaaacggttacgttaacggtcggtaacccgttgacccgttacttaacgttcgtttaacccg

SEQ ID NO: 443134 - DNA, 537 bp, Homo sapiens
  misc_feature: GZ8MTXP02JQBSQ.44.1.A01.1.454.CMB.2.raw
  modified_base (339)..(339): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattgatatctggttggctggtatcagcagaaaccaggaatgcccctaaggtcctgatctataaggcgtctagttagaaagtggggtccatcaaggtcagcggcagtgatctgggacngaattcactctcacatcagcagcctgcagcctgatgtatttgctaaattattactgaccaaacagtaataaagtagtttattactctaggtaggttttggaccgtaagggggtacccaaagggcgttagggaacgtaacgttaccgaaaacggtaacgttggtacgggaccttaggaccacccgtaagttactttcgg

SEQ ID NO: 443135 - DNA, 517 bp, Homo sapiens
  misc_feature: GZ8MTXP02GOT4B.44.1.A01.1.454.CMB.2.raw
  modified_base (357)..(357): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattgatatctggttgcctggtatcagcagaaaccagggaatcgcccctaaggtcctgatctataaggcgtctagtttagaaagtgggtccatcaaggttcagccggcagtggatcgtgggacagaattcactcncaccatcagcagcctgcagcctgatgtatttgactaaacttattactgacaaactagtataaagagtttaattctactagtagttttggaccgtaagggggacccaaaggcgtaggaagacgtaacgaaaacggaactggtaggctagacaccatcttcg

SEQ ID NO: 443136 - DNA, 501 bp, Homo sapiens
  misc_feature: GZ8MTXP02FSZ6Y.44.1.A01.1.454.CMB.2.raw
  modified_base (345)..(345): a, c, t, g, unknown or other
tcagacagtatatacacgaccggtgctcgatttagacgtctcatcaggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattgatatctggttggcctggtatcagcagaaaccagggaatgcccctaaggtcctgatctataaggcgtctagttagaaagtggggtccatcaaggttcagccggcagtggatcgtgggacngaattcactctcaccatcagcagctgcagcctgatgtatttgctaaacttattactgccaacagtaataagtagttattctacagtagtttggcctagggggaccaagctaggagacgtacgaaacgacgtgtacggactcgcaccgactcttacg

SEQ ID NO: 443137 - DNA, 818 bp, Homo sapiens
  misc_feature: GZ8MTXP02H64XX.44.1.A01.1.454.CMB.2.raw
  modified_base (188)..(188): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggccagtcagtagtattgatatcgtggttggcctggtatcagcaagaaaccagggaatcgacccctaaggtcctagacttctagtaacgggcgttacgttaaaggttttaacggaaaacgggtttcgggggttaccccaagtttaccggaaaacggggtttccgaacggggtccccgggaccgtaaaggggttggggtaactttcccggtaggggggaaacctaggggttaaaacttttcccgaaacccgttcccgttacccaaacccctaattacccgaaacggtcccaaacgggtcccccttgggacccaacggtccccgtttagggtaactttacgggttaattttttacggaacctttaaaaccgtttttaaagttttaaacccttaccgggtaaaccctaaaaccgtaaagggtttaaaccttaaaaggtttaaaggtttaacttttacccgtaacggtttaaagggttacgggttttttaccggggaaccccgggtaaaaggggggtaacccgtaaaagggtccggtaaggggtaaacgtaacgtaaaccgtaaaacgtaaccgttggtcggtacgtacggacctacccgtatttccgttccg

SEQ ID NO: 443138 - DNA, 516 bp, Homo sapiens
  misc_feature: GZ8MTXP02JO590.44.1.A01.1.454.CMB.2.raw
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaccagatcagtcaccaaacctcctacatcaagtactaccttccccgtcatctcgacggggtcccctgagttcagtggcagtgatctgcgacagtctttccaccctcacccatacaaatacgcctaggaagctagaagatgctgacaacgtattactgtcatcagtagtagtagttacctcggtctacgtttcggaccgtaggggaccaaggtcgtaggacgactacgaaacgactggtgctgcaccatactcgtctactac

SEQ ID NO: 443139 - DNA, 513 bp, Homo sapiens
  misc_feature: GZ8MTXP02HDL3M.44.1.A01.1.454.CMB.2.raw
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccagatcagtcaacccaaacctcctacatcaaagtactaccttccccgtcatctcgacgggtcccctgagttcagtggcagtgatctgcgacagcttccaccctcaccatcaaatcgccgtagagctagaagatgctgacaacgtatactgtcatcagtagtagttacgttaccgtcgtactacgtttcggccgtagggacaaggcgtaggagacgtacgaaacgtacgtgtgctcgcacactctcgtcttactac

SEQ ID NO: 443140 - DNA, 505 bp, Homo sapiens
  misc_feature: GZ8MTXP02GBJ3T.44.1.A01.1.454.CMB.2.raw
  modified_base (347)..(347): a, c, t, g, unknown or other
  modified_base (357)..(357): a, c, t, g, unknown or other
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccagatcagtcaccaaacctcctcatcaagtatacttccccgtccatctcacgggtcccctgagttcagtggcagtggatctgcgacagntttcaccctnaccatcaaatcgcctgaagctgaagatgctgcaacgtattactgtcatcagtagtagtagtttaccctggtctacgttttggcctagggggaccaaaggtcgtaggagactacgaaacgaactcgtggctgcaccatctgtcttctac

SEQ ID NO: 443141 - DNA, 515 bp, Homo sapiens
  misc_feature: GZ8MTXP02F5PRM.44.1.A01.1.454.CMB.2.raw
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccagatcagtcaccaaacctcctcatcaagtactaccttccccgtcatctcacggggtcccctgagttcagtggcagtgatctgcgacagtctttccaccctcaccatcaaatcgcctggaagctagaagatgctgacaacgtatactgtcatcagtagtagttagttaccgtcggtctacgtttcggaccgaggggtaccaagcgtaggagacgtacgaaacgactacgtggactcgacactactctcgtcttctac

SEQ ID NO: 443142 - DNA, 509 bp, Homo sapiens
  misc_feature: GZ8MTXP02JG8PT.44.1.A01.1.454.CMB.2.raw
  modified_base (406)..(406): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattgatatctggttggcctggtatcagcagaaaccaggaatgcccctaaggtcctgatctataaggcgtctagttagaaagtggggtccatcaggttcagccggcagtgatcgtgggacagattcactctcacatcagcagcctgcagcctgatgtatttgactaaacttataactcgaccaanagtaataagtattattctatagtagtttgggcctaagggggaccaaaggcgtagggaatacgtaacaaaacgacgtaagtggactacggccaacctactctcg

SEQ ID NO: 443143 - DNA, 483 bp, Homo sapiens
  misc_feature: GZ8MTXP02GWLDF.44.1.A01.1.454.CMB.2.raw
  modified_base (291)..(291): a, c, t, g, unknown or other
  modified_base (337)..(337): a, c, t, g, unknown or other
  modified_base (351)..(351): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattgatatctggttgctggtatcagcagaaaccagggaatgcccctaaggtcctgatctataaggcgtntagttagaaagtgggtccatcaaggtcagcgcagtgatctgggacngaatcactctcacntcagcagctgcagctgatgtatttgactaattattactgaccaactagtaataagtagtttattctctagtagtttaggacgacgggaccagcgtaggagactacgaacgatgtcgactcgacactatctcg

SEQ ID NO: 443144 - DNA, 550 bp, Homo sapiens
  misc_feature: GZ8MTXP02G7HJR.44.1.A01.1.454.CMB.2.raw
  modified_base (288)..(288): a, c, t, g, unknown or other
  modified_base (327)..(327): a, c, t, g, unknown or other
  modified_base (343)..(343): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattgatatctggttgctggtatcagcagaaccaggaatcgcccctaaggtcctgatctataggcgtntagttagaagtgggccatcaagtcagccgcagtgatcgngggacagattcactcncacatcagcagcctgcagctagatgtatttagactaaactttattactcgtaccaaactaggtaataaggtatttacgttcctagtaggttacggttttggacccggtaacggggtaaccgaaggaccgttaggggaaacgtaacgttaaaccgaaaacgggttaaacctgggttacggacgttacggacctaccgtacttctttcg

SEQ ID NO: 443145 - DNA, 553 bp, Homo sapiens
  misc_feature: GZ8MTXP02FOLRK.44.1.A01.1.454.CMB.2.raw
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactcggtcccagcaagaaaccagatcagtccaacccaaacctcctacatacaagtactaccttccccgccatcctcgacggggtcccctggaggttcaggtggcagtggatcgtgcgacagtcttccaccctcacccatacaaatcgcctaggaagcgtagaagatgcctagactaacgttattactgtacatacaagtagttaagttacgtttacccgtcggtacttacgtttcggaccggaacggggaccgaagcgtaggagaactacgaaacgtacgtagtgacgtgacacctagtctcgtcttactacc

SEQ ID NO: 443146 - DNA, 588 bp, Homo sapiens
  misc_feature: GZ8MTXP02GHGZ5.44.1.A01.1.454.CMB.2.raw
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcaagaaaccagatcagtaccaacccaaaccctcctacatacaaagtactaccttccccgtccatctcgacgggtcccctgtagtcagtggcagtgatctgcacagtcttccacctcaccatacaaatcgcctggaacgctagaagatagctagactaacgtattactgtacatacgagtagttacgttacgtttacccgtcggtaccttacgtttacgggaccgtaacggggaaccaaacggtccgttagggaacgtaacgtaaaccgaaaaccgtaacgtacggtcggtaccgtaacgacccgtaacctacgttaccgtcgttccttacctacccg

SEQ ID NO: 443147 - DNA, 539 bp, Homo sapiens
  misc_feature: GZ8MTXP02GBM1W.44.1.A01.1.454.CMB.2.raw
  modified_base (392)..(392): a, c, t, g, unknown or other
tcagacagtatatacacgaccggtgctcgatttagacgtctcatcagggggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccagatcagtccaaccaaacctcctacatacaaagtactaccttcccccgtcatctccgacggggtcccctggagttcaggtggcagtggatctgcacagctttccaccctcaccatacaaatcgcctaggaanctagaagatgctagactaacgtattactgtcatcaagtagttaggttagttaccgtcggtctacgtttcggaccgtaggggtaccaaggtcgtaggagaactaacgaaaacgtacgtcggtaggctaagacactatctctctactac

SEQ ID NO: 443148 - DNA, 573 bp, Homo sapiens
  misc_feature: GZ8MTXP02F08ES.44.1.A01.1.454.CMB.2.raw
tcagacagtatatacacgaccggtgctcgatttagacgtctcatcagggggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccagatcagtcaaccaaacctcctacatcaaagtactacttccccgtccatctcacggggtcccctgagttcagtggcagtgatctgcacagcttccaccctcacccatacaaatacgcctaggaagctagaagatgctagactaacgtatactgtcatcagtagtacgttaagttaccgtcggacttacgtttcggaccgaaggggtacccaaaggtacgtagggaagtaacgtaaacgaaaacggtaaaccgtcggtacggtaccgtaacggacctaaccgtaacttccgttacggttccttacgttaacccg

SEQ ID NO: 443149 - DNA, 542 bp, Homo sapiens
  misc_feature: GZ8MTXP02I8SDH.44.1.A01.1.454.CMB.2.raw
  modified_base (241)..(242): a, c, t, g, unknown or other
  modified_base (282)..(282): a, c, t, g, unknown or other
  modified_base (310)..(310): a, c, t, g, unknown or other
  modified_base (318)..(318): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagtagtatgatatctggtgctgtannagcagaacgaggaatcgaccctagtctgatctataggctntagttagaagtgggccatcagtcagcgnagtgatgnggacagtatcactctcacatcagcagcctgcacgccgtagtattggtatttacgacttaaacttagtttaaacctacgtaacctaaacgtaggttaaataaacggttatttacttactacgttagttacggtttcgggaaccgtaagggggtaccaggtaccgtaggaagtacgtaaccgaaaacgtacgtggtacggactacggacctacgtacttctttacg

SEQ ID NO: 443150 - DNA, 571 bp, Homo sapiens
  misc_feature: GZ8MTXP02GAK49.44.1.A01.1.454.CMB.2.raw
  modified_base (367)..(367): a, c, t, g, unknown or other
  modified_base (400)..(400): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctggtaggagacagacgtcaccatcacttcggccgggccagtcagtagtattgattagtcgtgggttcggtccgtggtaactcgagacaagaaaccgagggaactcggaccccgtaaggtcctagtatactaagtaacggcgttacttaaggttaagaaagggtcggggtccatcgaaggtcagccgngagtgatcgagggacagactcactcctcaactntcagcacgcgtagcacgcctagtactgttactttacgaacttaaacgtttactacgtcgaacctaacgtagtaaataagtagtttatctacgtagttagtttcgaccgtagggaccaggctaggaactactaacgaaacgtagtgtcggacttcgaccactacttcttacg

SEQ ID NO: 443151 - DNA, 522 bp, Homo sapiens
  misc_feature: GZ8MTXP02GP6IS.44.1.A01.1.454.CMB.2.raw
  modified_base (260)..(260): a, c, t, g, unknown or other
  modified_base (341)..(341): a, c, t, g, unknown or other
  modified_base (346)..(346): a, c, t, g, unknown or other
  modified_base (358)..(358): a, c, t, g, unknown or other
  modified_base (363)..(363): a, c, t, g, unknown or other
  modified_base (492)..(492): a, c, t, g, unknown or other
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccngatcagtccaaccaaacctcctcatcaaagtactactccccgtcatctcacggggtcccctgagtcagtcggcagtgatcngcgangtattcaccctnaccancaatcgctgagctagaacgatgctgactaacgtatactgtcatcgagagtagtacgttacctcggtactacgtttcggacgtacggggaacctaaggccgtaggaacgtactacgaaacgtacgtacgnggtctgcaacctatctacgttcttactacc

SEQ ID NO: 443152 - DNA, 564 bp, Homo sapiens
  misc_feature: GZ8MTXP02JSGDO.44.1.A01.1.454.CMB.2.raw
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattgatatcgtggttggcctggtatcagcagaaaccaggaatcgccctaaggtcctgatctataaggtcgtactagttagaaagtcggggtacccagtacaaggttcagccggacaggtggatcgtagggacagtaaacttcgactctcaaccatcaagcctaagccctagcacgccttgattgtagttttcgacttaaactttattactacgtacctaaataggttaaataaagtagtttaatccgttagtaagttaggtttcggaccgtacgggggaacctaggacgtaggaacgtactacgaaaacgtcgtaaggtcgactcgacaccgattcgttacg

SEQ ID NO: 443153 - DNA, 701 bp, Homo sapiens
  misc_feature: GZ8MTXP02GWLJ2.44.1.A01.1.454.CMB.2.raw
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttcgccgggcagtcagagtattgatatcgtggttgctggtatcagcaagaaaccgaggaactcgaccccgtaaggtcctagattcgtaagtaacgggtcttacgttaaggtttaaggaaaagggttccggggtacctagtacgtaaggttcgagccggacgaggtggaagttcggtagggaactaggtaacttcactcctaccaaccataccgagccaacggctcggacacgtccgttagattggttaactttcgaacttaaactttacttaacgtaccgtaccctaaaagttagttaaagttaaaggtttactttaacgttcttacggttaacggtttacgggttttacggggaacccgggttaaacgggggaaacccttaagggtaccgggttaagggaaaccggttaacgtaaaacccgtaaaacgggttaacggtcgggggttacgtaaacgtttacgggaaccctaaccgtttaacggtttccttttacccg

SEQ ID NO: 443154 - DNA, 646 bp, Homo sapiens
  misc_feature: GZ8MTXP02GIR1C.44.1.A01.1.454.CMB.2.raw
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccggccagtcagagcattgctagtagcttacactggtccccagacaagaaaccagatcagtaccaaccaaacctcctacaactacaaacgtacttacccttccccgtaccaactccgtacgtaccggggttccccctcggtacgggtttaccaagggttcgggacctagggttacgggacttccgtcgggaccaacgtacgtacttttcccaacccctcaaacccattaaccgaaattacggacccttaggggaaacgtaccgttaggaaacgtaagttcgacgtacggacctaaacgttagttaacctgtactatacgagtagtagttacgttaccgcggtctacgtttcggaccgtaggggacacggtacgtaggagaactacggaaacgtacgtcggtcggtacaagaccactactcgtacgttccttacttacc

SEQ ID NO: 443155 - DNA, 590 bp, Homo sapiens
  misc_feature: GZ8MTXP02J0MNN.44.1.A01.1.454.CMB.2.raw
  modified_base (343)..(343): a, c, t, g, unknown or other
tcagacagtatatacacgaccggtgctcgatttagacgtctcatcagggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcagaaaccagatcagtccaccaaacctctcatcaagtactaccttccccgcatctcgacgggtcccctgagttcagtgcagtgatctgcacngtcttccaccctcaccatacaaatcgccgtaggaagcgtagaacgatgctagactaacgttacttactgtactatacgtaagtagttaggttaacgtttaccgtcggttaccttacggttttcgggaccgtacggggtaaccaacggcgtacggaaggtaacttaaacgaaaacgtaacgtacggtacggtacctaacggaccctaaccggtacttccgttacgtttaccgtttaccgtttaccccg

SEQ ID NO: 443156 - DNA, 576 bp, Homo sapiens
  misc_feature: GZ8MTXP02FQQ14.44.1.A01.1.454.CMB.2.raw
  modified_base (188)..(188): a, c, t, g, unknown or other
  modified_base (558)..(558): a, c, t, g, unknown or other
tcagacagtatatacacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagagtatgatatctggttgctgtatcagcagaaccaggatgcccctaaggtcctagagtctaataaggcgttacttaaggtttacgaaaaggttggggtaccccagtaccgaaagggtttccaaggcccggtcgagtagggattcgtaggggacaggtaatttcgaactctcaactatcagccagccctggactagcctgagttgtatttggacctaaatttacttacgtcgacctaacgtagttaaataacgtaagttcttactacgaagttagtttacgggactacggggaaccaggtacgtaggaacgactaacgaaaacgtacgtaaggtcgcgttanacctaccgtatcgttacg

SEQ ID NO: 443157 - DNA, 467 bp, Homo sapiens
  misc_feature: GZ8MTXP01A1C48.45.62.F07.1.454.CMB.2.raw
  modified_base (386)..(386): a, c, t, g, unknown or other
  modified_base (404)..(404): a, c, t, g, unknown or other
  modified_base (443)..(443): a, c, t, g, unknown or other
  modified_base (454)..(454): a, c, t, g, unknown or other
  modified_base (461)..(467): a, c, t, g, unknown or other
tcagacgcgatcgacacgaccggtgctcgatttagtagtcgcataaagggaaagggggtcaggctggaactgaggagcaggtgggggcacttctccctctaacactctcccctgttgaagctctttgtgacgggcgagtcaggccattggtttttagtgtggtttcagcagaaaccagggaaagtccctaagcgtctgatctttgctacacccagtttccaaggtggggtcccatcaagattcagcggcactggatctgggacagaattcactctcactatcagcagcctgcagcctgaagtattttgcgtacttattattgtctacacataatgttatccgtggcgttcggccgaagggaccaaggtgaaatcaaaaacgactgnggctgcacatctgtcttnatcttccgcatctgatcgatcgcgtctggagggcggggntgggcaaggcncgatagnnnnnnn

SEQ ID NO: 443158 - DNA, 466 bp, Homo sapiens
  misc_feature: GZ8MTXP01C9GT9.45.62.F07.1.454.CMB.2.raw
  modified_base (388)..(388): a, c, t, g, unknown or other
  modified_base (460)..(466): a, c, t, g, unknown or other
tcagacgcgatcgacacgaccggtgctcgatttagtagtcgcataaagggaaagggggtcaggctggaactgaggagcaggtgggggcacttctccctctaacactctcccctgttgaagctctttgtgacgggcgagtcaggccattggttttttagtgtggtttcagcagaaaccagggaaagtccctaagcgtctgatctttgctacacccagtttccaaggtgggtcccatcaagattcagcggcactggatctgggacagaattcactctcactatcagcagcctgcagcctgaagtattttgcgtactttattattgtctacaccataatagttatccgtggcgttcggccaagggaccaaggtgaaatcaaaaacgactgngctgcaccatctgtcttcatctccgcatctgatcgatcgcgtctgacgggcgggctggcaaggcgcagtagnnnnnnn

SEQ ID NO: 443159 - DNA, 469 bp, Homo sapiens
  misc_feature: GZ8MTXP01AT7EE.45.62.F07.1.454.CMB.2.raw
  modified_base (466)..(469): a, c, t, g, unknown or other
tcagacgcgatcgacacgaccggtgctcgatttagtagtcgcataaagggaaagggggtcaggctggaactgaggagcaggtgggggcacttctccctctaacactctcccctgttgaagctctttgtgacgggcgagtcaggccattggtttttagtgtggtttcagcagaaaccagggaaagtccctaagcgtctgatctttgctacacccagtttccaaggtggggtcccatcaagattcagcggcactggatctgggacagaattcactctcactatcagcagcctgcagcctgaagattttgcgtacttattattgtctacaccataatagttatccgtgggcgttcggccaacggggaccaaggtggaaatcaaaaacgaactgtggctgcaccatctgtcttcatcttcccgccatctgatcgatcgcgtctggacggcgggctggcaaggcgcatagnnnn

SEQ ID NO: 443160 - DNA, 458 bp, Homo sapiens
  misc_feature: GZ8MTXP02JCOQO.45.62.F07.1.454.CMB.2.raw
  modified_base (428)..(428): a, c, t, g, unknown or other
  modified_base (453)..(458): a, c, t, g, unknown or other
tcagacgcgatcgacacgaccggtgctcgatttagtagtcgcataaagggaaaggggtcaggctggaactgaggagcaggtgggggcacttctccctctaacactctcccctgttgaagctctttgtgacgggcgagtcaggccattggtttttagtgtggtttcagcagaaaccagggaaagtccctaagcgtctgatctttgctacacccagtttccaaggtgggtcccatcaagattcagcggcactggatctgggacagaattcactctcactatcagcagcctgcagcctgaagattttgcgactttattattgtctacaccataatagttatccgtgggcttcggccaaggggccaaggtgaaatcaaacgaactgtagctgcaccatctgtcttcatctccgcatctgatcgatcgcgtcngagcgggctgggcaaggcgcatagnnnnnn

SEQ ID NO: 443161 - DNA, 469 bp, Homo sapiens
  misc_feature: GZ8MTXP02HUR55.45.62.F07.1.454.CMB.2.raw
  modified_base (303)..(303): a, c, t, g, unknown or other
  modified_base (465)..(469): a, c, t, g, unknown or other
tcagacgcgatcgacacgaccggtgctcgatttagtagtcgcataaagggaaagggggtcaggctggaactgaggagcaggtgggggcacttctccctctaacactctcccctgttgaagctctttgtgacgggcgagtcaggccatttggtttttagtgtggtttcagcagaaaccagggaaagtccctaagcgtctgatctttgctacacccagtttccaaggtggggtcccatcaagattcagcggcactggatctgggacagaattcactctcactatcagcagcctgcagcctgaagnttttgcgtacttatattgtctacaccataatagttatcgtggcgttcggccaagggaccaaggtgaaaatcgaaaacgactggtgctgcaccatctgtcttcatccttcccgctatctgatcgattcgcgtctggagcggggctgggacgaaggcgcatagnnnnn

SEQ ID NO: 443162 - DNA, 527 bp, Homo sapiens
  misc_feature: GZ8MTXP02I8BIN.45.62.F07.1.454.CMB.2.raw
  modified_base (505)..(505): a, c, t, g, unknown or other
  modified_base (507)..(527): a, c, t, g, unknown or other
tcagacgcgatcgacacgaccggtgctcgatttagtagtcgcataaagggaaagggggtcaggctggaactgaggagcaggtgggggcacttctccctctaacactctcccctgttgaagctctttgtgacgggcgagtcaggccatttggttttttagtgtggtttcagcagaaaccagggaaagtccctaagcgtctgatctttgctacacccagtttccaaggtggggtcccatcaagattcagcggcactggatctgggacagaattcactctcactatcagcagcctgcagcctagaatattttgcgtactttattattgtactaacacctattaaatagttactccggtgggtccgttcggaccgaaggggaccaaagggtggaaaatcaaaacgactggtagctgaccaaccattctgttcttcacttccttcccgcctatctgatcgatcgcgtactggacggcgggtctacgggacgaagggccgacgaagtacgngnnnnnnnnnnnnnnnnnnnnn

SEQ ID NO: 443163 - DNA, 510 bp, Homo sapiens
  misc_feature: GZ8MTXP01D24QW.10.59.F04.1.454.CMB.2.raw
  modified_base (344)..(344): a, c, t, g, unknown or other
  modified_base (380)..(380): a, c, t, g, unknown or other
  modified_base (426)..(426): a, c, t, g, unknown or other
  modified_base (430)..(430): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgttcctggtaccaacagcagccaggcgaaacgcccccaaattcatgatttatgatgtcagtgcgcggcctccgggggtcctgatcgcttcnctggctccaagtctggcacacgcctcctgaccatcnctgcctcacgcctgagatgaggggctgtattattactgttgctacnttangtcagggtcgtacgcgttgggttcgttcggcgggagggccaaggctggtaaccgtcgtaggttctaacgcccgtaacggg

SEQ ID NO: 443164 - DNA, 469 bp, Homo sapiens
  misc_feature: GZ8MTXP01A8I2V.10.59.F04.1.454.CMB.2.raw
  modified_base (345)..(345): a, c, t, g, unknown or other
  modified_base (363)..(363): a, c, t, g, unknown or other
  modified_base (391)..(391): a, c, t, g, unknown or other
  modified_base (393)..(393): a, c, t, g, unknown or other
  modified_base (395)..(395): a, c, t, g, unknown or other
  modified_base (397)..(397): a, c, t, g, unknown or other
  modified_base (403)..(403): a, c, t, g, unknown or other
  modified_base (405)..(405): a, c, t, g, unknown or other
  modified_base (407)..(407): a, c, t, g, unknown or other
  modified_base (410)..(410): a, c, t, g, unknown or other
  modified_base (416)..(416): a, c, t, g, unknown or other
  modified_base (418)..(418): a, c, t, g, unknown or other
  modified_base (448)..(448): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctgctcagtgtccggtctcctggcagtcagtcacatctcctgcactggaaccagcagtgatgtgtgtatgacttgctctgtacaacagcagccagcaagccccaaattcatgatttatgatgtcagtgcgcggccccctcgggggtcctgatcgcttctctggctccaagttcnggcaaacacggcctcccngaccatctctggcctccagcctgagagngngntntatatntntnctntatatngngcgcgtcgttggtgtcggcggcggacgaancgcgcgtcgttacgtcgcgcg

SEQ ID NO: 443165 - DNA, 514 bp, Homo sapiens
  misc_feature: GZ8MTXP01EJADX.10.59.F04.1.454.CMB.2.raw
  modified_base (300)..(300): a, c, t, g, unknown or other
  modified_base (362)..(362): a, c, t, g, unknown or other
  modified_base (472)..(472): a, c, t, g, unknown or other
tcagcatagtagtgcacgaccggtgctcgatttagtacacacacttagggattggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtgtggttatgacttgctctggtaccaacagcagccaggcgaaacgcccccaaattcatgatttangatgtcagtgcgcggccccctcgggggtcctgatcgcttctctggctccagtctggcaaacnccggctccctgaccatctctggccctcagcctgacgatcggggaggtctgacttagttactgttgctctatatgcgaaggtccggttacgtcgttgggtgttcgggcggngggacccaaggctcggaccgtcgttacggtcaacggaacccg

SEQ ID NO: 443166 - DNA, 500 bp, Homo sapiens
  misc_feature: GZ8MTXP01AHC99.10.59.F04.1.454.CMB.2.raw
  modified_base (365)..(365): a, c, t, g, unknown or other
  modified_base (447)..(447): a, c, t, g, unknown or other
  modified_base (466)..(466): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgctcctggtaccaacagcagccaggcgaacgcccccaaattcatgatttatgatgtcagtgcgcggcccccgtcgggggtcctgatcgcttctctggctcagtctggcaacncgcctccctgaccatctctggcctccagcctgaggatgggaggctgattattactgtgctcatatcgcaaggcggttaccgngttggggtgttcgggcggnggacaaggctgacccgtcacggtcaacgaacccg

SEQ ID NO: 443167 - DNA, 511 bp, Homo sapiens
  misc_feature: GZ8MTXP01E1W6M.10.59.F04.1.454.CMB.2.raw
  modified_base (457)..(457): a, c, t, g, unknown or other
  modified_base (464)..(464): a, c, t, g, unknown or other
tcagcatagtagtgcacgaccggtgctcgatttagtacacacacttagggagttgggggggtctcaggaggcagcactctcgggacgtctccaccatggcctgggctctgctcctcctcagcctcctcactcagggcacaggatcctgggctcagtctgccctgactcagcctcgctcagtgtccggtctctggcagtcagtcaccatctcctgcactggaaccagcagtgatgtgtgtatgacttgctctggtaccaacagcagccaggcgaacgcccccaaattcatgtatttatgatgtcagtgcgcggccccctcgggggtcctgatcgcttctctgctccagtctcgggacaacgaccgccctccccgtgacccatcctcgtcggccctccagcccgtgacgatggggaggctgtattattactgtttgctctatatgcaagggcgttacgngttgggngtcggcgggaggccaagcgtcgaccgtccttaggtccaacgaacccg

SEQ ID NO: 443168 - DNA, 519 bp, Homo sapiens
  misc_feature: GZ8MTXP01ERPKX.10.59.F04.1.454.CMB.2.raw
  modified_base (422)..(422): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccggtctctggcagtcagtcacatctcctgcactgaaccagcagtgatgtggtgtatgacttgctctggtaccaacagcagccaggcgaacgcccccaaattcatgatttatgatgtcagtgcgcggcccccgtcgggggtcctgactcgcttctctggctccagtctggcaacgaccgcctccctgaccatctctcggcctccagcctgagatgggaggtctgattattatgctgcctnattatgcgaggccggaccgtttgggttcccgggttattcgttcgttaccgggaacgttcggggaacctacggtccacccgtccgttaacgggtcccg

SEQ ID NO: 443169 - DNA, 578 bp, Homo sapiens
  misc_feature: GZ8MTXP01CM5ZY.10.59.F04.1.454.CMB.2.raw
  modified_base (209)..(209): a, c, t, g, unknown or other
  modified_base (391)..(391): a, c, t, g, unknown or other
  modified_base (454)..(454): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggcggccccagatgggtcctgtcccagctgcagctgcatgagtcgggcccaggactggtgaggccttcggatacccctgtccctnagttgcgctgtctctggtgctccatcaacagtgtgacaactggtggggctgggtccgccagcccccagggatggggactggagtggattggccttacacattatagtgggactacccactacaacccgtcctccaggagtcgagtcaaccatctcactagacacgtccagactcactctccngacgtgacctctgtcgaccgccgcgacacgggccgtgtattattgtcgcgagacgtaccccgntaggaagtcttccgaactaaagttcgttaccgttttgaaaccccgtggttcggggggcccaacgggggtaaccgccccgtttcggggtccctacccgggttccttaaccccgttcaaccccggg

SEQ ID NO: 443170 - DNA, 631 bp, Homo sapiens
  misc_feature: GZ8MTXP01D6KUH.10.59.F04.1.454.CMB.2.raw
  modified_base (227)..(227): a, c, t, g, unknown or other
  modified_base (233)..(233): a, c, t, g, unknown or other
  modified_base (261)..(261): a, c, t, g, unknown or other
  modified_base (293)..(293): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcacatctctgcactggaaccngcagtnatgtggtgtatgattgctctgtaccaangcagcaggcaacgccccaaattcatgatttangatgtcagtcgcgccggtcccccgtcgggggtcctgactccgtcttctcgtacggcctccgaagtcgtacgggacctaaaccgccggccctccccgtagaaccctattcctccgtcggtccctccgaacgcccgtaggacgggtattgggggaacggttcgttacgttaatttacgttcgtgttacgtactacgtagttacgtcggacggtaacggggttaccggttaccgggttcggtttcgggggttcggtaccgggggacgggttacgggttaacccgtaacggtccgtaaccgggtacccggttacggttacgtaacccggaaccggtaacccg

SEQ ID NO: 443171 - DNA, 522 bp, Homo sapiens
  misc_feature: GZ8MTXP01BA2J2.10.59.F04.1.454.CMB.2.raw
  modified_base (209)..(209): a, c, t, g, unknown or other
  modified_base (227)..(227): a, c, t, g, unknown or other
  modified_base (263)..(263): a, c, t, g, unknown or other
  modified_base (296)..(296): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcaccntctcctgcactggaaccngcagtgatgtgtgtatgacttgctctggtaccaacngcagccaggcgaacgccccaaatcatgatttangatgtcagtgcgcggcccccgtcgggggtcctgactcgtcttctctcggcctccaacgtctggacaacaccggtcctcccgtgaccatcctctcggccctccagcctgacgatcgggagtctgtattattacgtgttacgctctatatcgcgtggccggttccgtgttggggtcgttcgggcgggttgggaccaaggctcggaccgtcgttaggtccgaacgcccg

SEQ ID NO: 443172 - DNA, 568 bp, Homo sapiens
  misc_feature: GZ8MTXP01A6IZI.10.59.F04.1.454.CMB.2.raw
  modified_base (209)..(209): a, c, t, g, unknown or other
  modified_base (239)..(239): a, c, t, g, unknown or other
  modified_base (456)..(456): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggcggccccagatgggtcctgtcccagctgcagctgcatgagtcgggcccaggactggtgaggccttcggatacccctgtccctnagttgcgctgtctctggtgctccatcaacngtggtgacaacgtggtggggctgggtccgccacggccccccaggggatgggactggagtggattggccttacacattatagtgggactaccactacaacccgtcctcaggagtcgagtcaaccatctacactagacacgtcagaactcacctctccctgacgtgacctctgtcgaccgcgcggacacggccgtgtattatgtgcgagacgaccccgntagaacgtcttcctaactaaattcgtacttttcggaaccctacggttcgggggcccacgggggtaaccgtccccgtggggttcccacccggttcctcccgttcgaaccccgg

SEQ ID NO: 443173 - DNA, 556 bp, Homo sapiens
  misc_feature: GZ8MTXP01AIA9F.10.59.F04.1.454.CMB.2.raw
  modified_base (305)..(305): a, c, t, g, unknown or other
  modified_base (548)..(548): a, c, t, g, unknown or other
tcagcatagtagtgcacgaccggtgctcgatttagtacacacacttagggattggggggggtctcaggaggcagcactctcgggacgtctccaccatggcctgggctctgctcctcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggacaaacgcccccaaatgatgatttangatgtcagtaatccgaccctgtaggggtttctgactcgtcctttcttgccctccaagtctggccaacgaccggccctccctgaccattctcgtgggctccgagactggacggacgaggctagtattatactgcagctacacatacagcggcgaggtcgggttgggtcggttcggggcgggggaccacgacgttcggaccgtcgttacggttcgacgcccgaggccgtcgccccgttcggtccncgttcccg

SEQ ID NO: 443174 - DNA, 675 bp, Homo sapiens
  misc_feature: GZ8MTXP01CV5V4.10.59.F04.1.454.CMB.2.raw
  modified_base (263)..(263): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggcagtcagtcacatctctgcactggaaccagcagtgatgttggtgtatgtacttgctctgtacaangcagcaggcgaacgacccctaaatcatagtattatgtatgtctagtcgcggccggtcccccggtcgggggtcctgtactccgtcttcgtcgtcggtcctaccgtacgtcgtacggacaacccgccggtccctacccgtacgtacctcgttccctcgttccgggtccctaccgaccggtaccgtagggaacggttacgtagggggtaaccggttcgtttaagttaacgttttaacgttacgttacggtttctaccgtttactaagttacgtacggacgggttaacggggtacccgggttccggttcgggtttcgggggttaccgggtcgggggttaacgggacggggttaaccgtaacggtcggttccggtaccggttccggttaccgggtaaccgttaaccgggtaacccgg

SEQ ID NO: 443175 - DNA, 723 bp, Homo sapiens
  misc_feature: GZ8MTXP01BGC8N.10.59.F04.1.454.CMB.2.raw
  modified_base (229)..(229): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtgattgttggtggttatgtactttgtctcctggtaccaacagcagccaggcgaaacgacccccaaattcatgtatttatgatgtcagtgcgccggccccgtcgggggtcctgctcgtcttctcgtcggcctaccgaagttccgtacgggaccaaaccgacccgggtccccttaccccgtacgaaccctacttcccgttccgtccgggtccccttacccgaacggtccccgttagggaacggggtaacgttcgggggaaacgggttccgttagggttaacttttaacgttaaccgtttcggtttcgtacccttactacgttaagttcggaccggtaaccgggggtccgggttaccccgggtcgggttttacgggggttccggggtttaccggggttaccgggggttaacggggaacccgaaacgggtcccggttaaccgggtaaccccggttccggttaacgggtaacccggttaaccggtaacccccggg

SEQ ID NO: 443176 - DNA, 563 bp, Homo sapiens
  misc_feature: GZ8MTXP01DFPES.10.59.F04.1.454.CMB.2.raw
  modified_base (227)..(227): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcaccatctctgcactggaaccngcagtgattgtggtgtatgtacttgtctctggtaccaacagcagcaggcgaacgccccaaattcatgtatttatgatgtcagtgcgccggccccgtcggggtcctgctcgtcttctcgtggcctcgagtctggacacaccgccctcctcgacctatcctcgtcgcctccacgcctggagtacgtggggacggtcttaggtactttagttacgttgttcgccttctattacgtcgcggtaacgggtccggttaccggtcggtttggggtcggttcgggacgggttacggaccgaaggtcgtcggtaaccgtccgttaacggtccgaacggtaacccg

SEQ ID NO: 443177 - DNA, 650 bp, Homo sapiens
  misc_feature: GZ8MTXP01A63NZ.10.59.F04.1.454.CMB.2.raw
  modified_base (224)..(224): a, c, t, g, unknown or other
  modified_base (268)..(268): a, c, t, g, unknown or other
  modified_base (302)..(302): a, c, t, g, unknown or other
  modified_base (333)..(333): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggcagtcagtcaccatctctgcactgaaccngcagtgattgttggtggttatgtactttgtctctggtaccaacngcagccaggcgaacgccccaaattcatgtatttntgatgtcagtgcgcggccccgtcgggggtcngatcgtcttctctgcctaccgagtcgtgggaccaaccaccggccctcccgtgaccctatcctcgtcggccctccgacgcccgtggaaggtgtacggggacgggtcttaggttaatttacgtttaaccgtttggttcggtaccttacctaaagttagttcggccggtaacggggtcccgggtttacccggttcgggttttcgggggttcggggtttaccgggggaccgggggttaacgggggacccgttaaacggggcccgttaacgggtaccccggtacccggttacgggttaaccgttaaccgggtaacccccggg

SEQ ID NO: 443178 - DNA, 549 bp, Homo sapiens
  misc_feature: GZ8MTXP01CFUMQ.10.59.F04.1.454.CMB.2.raw
  modified_base (461)..(461): a, c, t, g, unknown or other
tcagcatagtagtgcacgaccggtgctcgatttagtacacacacttagggagttgggggggtctcaggaggcagcactctcgagacgtctccaccatggcctgggctctgctcctcctcagcctcctcactcagggcacaggatcctgggctcagtctgccctgactcagcctcgctaagtgtccgggtctcctgggcagtcagtcaccatctcctgcactggaaccagcagtgatgttggtggttatgtactttgctcctggtaccaacagcagccaggcgaacgcccccaaattcatgatttatgatgtcagtgcgcggtcccccgtcgggggtctgatcgtcttctctggctccaagtctcgggacaaaccgccggtccctcccgtagaccctattcctcgtcggccctccacgccctaggaggacttggggaaggtcttagtattattactggttanctctatagtcgcaagggtcgttacggtcgttggggtcggttcgggacgggcgggaccaagcgtgacccgtcgttacgtcgaacgtccg

SEQ ID NO: 443179 - DNA, 585 bp, Homo sapiens
  misc_feature: GZ8MTXP01BW2TQ.10.59.F04.1.454.CMB.2.raw
  modified_base (268)..(268): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcaccatctcctgcactggaaccagcagtgatgttggtggttatgactttgctctggtaccaacngcagccaggccgaacgcccccaaattcatgatttatgatgtcagtgcgcggcccccgtcgggggtcctgactcgcttctcgtggctccagtctaggacaaccgacggccctcccgtgacctatcctctccggccctccgacgcccgtagagtacgtggggacggtcttagtaactttacgttaccgttggttacgtacctactagtttacgcggtacggaacggggtcccggttaccggtcgggtttggggtcggttccggggacggggttacggaccgaagtcgtcgtacccgtcgttacggtcgcggtaaccccg

SEQ ID NO: 443180 - DNA, 516 bp, Homo sapiens
  misc_feature: GZ8MTXP01EHREE.10.59.F04.1.454.CMB.2.raw
  modified_base (227)..(227): a, c, t, g, unknown or other
  modified_base (401)..(401): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcacatctcctgcactgaaccngcagtgatgtgtgtatgacttgctctggtaccaacagcagccaggacgaacgaccccaaatcatgatttatgatgtcagtcgcgcggtcccccgtcgggggtcctgactcgtcttctcgtggctccgagtctcggcacacggcctcctgaccatctctcggcctcagcctgagntggggagtctgtattattacgtgttgctctatatgcgaagggtcgttacggtcgttggggtcgttcgggcgggaggaccgaagcgtcggaccgtcgacggtcgaacgtaacccgg

SEQ ID NO: 443181 - DNA, 519 bp, Homo sapiens
  misc_feature: GZ8MTXP01E3IQQ.10.59.F04.1.454.CMB.2.raw
  modified_base (226)..(226): a, c, t, g, unknown or other
  modified_base (298)..(298): a, c, t, g, unknown or other
  modified_base (415)..(415): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcaccatctcctgcactgaaccngcagtgatgtgtgtatgacttgctctggtaccaacagcagccaggcgaacgcccccaaattcatgtatttangatgtcagtgcgcggcccccgtcgggggtcctgactcgtcttctcgtggctaccagtcgtggacaacgaccggccctcccgtcgaccactctccgtcggccctccgagcctgaggangggaggctgtattatactgtgctctatatgctaaggtcggttccgtcgttggggtcgttcgggcgggacggaccaagctcgactccgttagtcgaacgaacccg

SEQ ID NO: 443182 - DNA, 544 bp, Homo sapiens
  misc_feature: GZ8MTXP01C0K3Z.10.59.F04.1.454.CMB.2.raw
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccggtctcctgggcagtcagtcaccatctcctgcactagaaccagcagtgatgtggtgtatgacttgctctgtacaacagcagcaggcgaacgcccccaaatcatgattatgatgtcagtgcgcggcccccgtcggggtcctgactcgcttctcgtggctcctaagtctcggacaacgaccgcctccccgtgaccctatccgtcttcggcccttccgagccctaggaggacttaggggagtcttagtattattcgttgcttgtctcgtatatggcaggcggtaccgttgggttaccgggtattcggttcgttacgggaactcggggtaacccacgggtccaccggttccgaacgggtaaccc

SEQ ID NO: 443183 - DNA, 573 bp, Homo sapiens
  misc_feature: GZ8MTXP01ARBMO.10.59.F04.1.454.CMB.2.raw
  modified_base (227)..(227): a, c, t, g, unknown or other
  modified_base (261)..(261): a, c, t, g, unknown or other
  modified_base (292)..(292): a, c, t, g, unknown or other
  modified_base (445)..(445): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgggcagtcagtcacatctctgcatggaaccngcagtgatgtggtgtatgtacttgctctgtacangcagcagcgaacgccccaattcatgtattantatgtcagtcgcgcggcccccgtcggggtctgctcgtcttctcgtgtcctcgagtctcggactaaacgccggcctcctgaccctatctcgtcgcctccgagcctggacgtacgtggggacggtctggtaacttagttactggttcgtaccttntacgttagcgtcggtaacgggtccgggttacgtccgggtttggggtcggttaccggggcgggacgggttaccctaagggtccgtaacgggtaccccggtcgttaacgggtccgaaccggtaaccccgg

SEQ ID NO: 443184 - DNA, 553 bp, Homo sapiens
  misc_feature: GZ8MTXP01AI7GA.10.59.F04.1.454.CMB.2.raw
  modified_base (227)..(227): a, c, t, g, unknown or other
  modified_base (302)..(302): a, c, t, g, unknown or other
  modified_base (441)..(441): a, c, t, g, unknown or other
  modified_base (446)..(446): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgtggtgttatgacttgctctggtaccaacagcagccaggcgaaacgcccccaaattcatgtatttangatgtcagtgcgccggccccgtcgggggtcctgactcgtcttctcgtggctcagtctggacacgaccgcctccctgaccatctcctcgccctccacgcctggaggtatggggagtctgtatttattacgtggttctctntaatntcggcgtaacgggtccggttaccggtcggttgggggtcggttcggggcgggttacggggaccctaaggtcgtcggacccgttcgacgggtcgaaccggtaaccccgg

SEQ ID NO: 443185 - DNA, 509 bp, Homo sapiens
  misc_feature: GZ8MTXP01A5FZE.10.59.F04.1.454.CMB.2.raw
  modified_base (225)..(225): a, c, t, g, unknown or other
  modified_base (300)..(300): a, c, t, g, unknown or other
  modified_base (343)..(343): a, c, t, g, unknown or other
  modified_base (501)..(501): a, c, t, g, unknown or other
tcagcatagtagtgcacgaccggtgctcgatttagtacacacacttagggattggggggtctcaggaggcagcactctcgggacgtctccaccatggcctgggctctgctcctcctcagcctcctcactcagggcacaggatcctgggctcagtctgccctgactcagcctcgctcagtgtccgggtctcctggcagtcagtcaccatctcctgcactggaaccngcagtgatgttggtgttatgactttgctctggtaccaacagcagccaggcgaacgcccccaaattcatgatttangatgtcagtgcgcggcccccgtcgggggtcctgactcgcttcnctggctccagtctggcaacacgcctcctgaccatctctcggcctccagccctgacgatgggaggctgactttatactgttcgctctatatgcaaggtcggttacgcgttggggtgttcgggcgggttaggcccgaagcgtcgaccgtcttacgggtcncgaacccg

SEQ ID NO: 443186 - DNA, 655 bp, Homo sapiens
  misc_feature: GZ8MTXP01BPKW4.10.59.F04.1.454.CMB.2.raw
  modified_base (229)..(229): a, c, t, g, unknown or other
  modified_base (272)..(272): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatccgtgggctcagtctgccctgactcagcctcgctcagtcgtccggtctccgtggcagtcagtcaccatcctctgcactggaaccngcagtgattgttggtggttatgtacttgctcgtcgtaccaacngcacgccgaggacgaaaccgaccccctaaattcatagtatttatgtatgtcgagtcgccggccggtcccccgtcgggggtcctgctcgtcttctcgtcggcctaccgagtccgtacgggaccaaaccgcccggtccctcccgtacgaccctactccgttccgtccggtccctaccgacgtcccgtagggaacggtacgtcgggggaacggttccgttaggttaacgttttacttaccggttgtttacgtccttactaagttacgtcggaacggtaacgggtcccgggttaccggtcgggtttggggtcgggttccgggacggggttacggaccgtaaggtccgtaacggtacccgtacggttacggtccgaacggtaaccccg

SEQ ID NO: 443187 - DNA, 521 bp, Homo sapiens
  misc_feature: GZ8MTXP01BYW3I.10.59.F04.1.454.CMB.2.raw
  modified_base (436)..(436): a, c, t, g, unknown or other
  modified_base (440)..(440): a, c, t, g, unknown or other
tcagcatagtagtgcacgaccggtgctcgatttagtacacacacttagggattgggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtggtggtatgacttgctctggtaccaacagcagccaggcgaagcccccaaattcatgatttatgatgtcagtgcgcggcccccgtcgggggtcctgactcgtcttctctggctaccagtctggacaacgacgcctccctgaccatcctcgtcggcctccacgcctgaggatggggacgtcttgtattattactgttgacttntatntcgcgaacggtcggttcgtcggttgggtcggttcgggcgggcggaccgaagtcgtcgtccgtcgttacggtccgaacgccg

SEQ ID NO: 443188 - DNA, 624 bp, Homo sapiens
  misc_feature: GZ8MTXP01B60Z6.10.59.F04.1.454.CMB.2.raw
tcagcatagtagtgcacgaccggtgctcgatttagtacacacacttagggagttggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcaccatctcctgcactggaaccagcagtgattggttggtggttatgtactttgctcgtggtaccaacagcagccgaggcgaacgcccccaaatcatgtatttatgatgtcagtgcgccggcccccgtcgggggtcctgatcgcttctcgtggcctccagtcgtcggacaaccgaccggccctcccgtacgaccctattccgtccgtcgggtccctccgacggtcccgtaggaaggactggggaacggtcttagtaatttattacgtgttcgccttatatagtcggccgtaaggggtcccggttacggtcggtttcgggggttcgggttccgggcggggaaccggggacccgtaacgggtcccgtaaccgggtaaccccgggttcccgttaagggttccccgaaccgggtaacccccgg

SEQ ID NO: 443189 - DNA, 499 bp, Homo sapiens
  misc_feature: GZ8MTXP01CL3MV.10.59.F04.1.454.CMB.2.raw
  modified_base (226)..(226): a, c, t, g, unknown or other
  modified_base (329)..(329): a, c, t, g, unknown or other
  modified_base (353)..(353): a, c, t, g, unknown or other
  modified_base (365)..(365): a, c, t, g, unknown or other
  modified_base (386)..(386): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccggtctcctgggcagtcagtcacatctcctgcactggaaccngcagtgatgtgtgtatgtacttgctctgtaccaacagcagccaggcgaacgcccccaaatcatgatttatgatgtcagtgcgcggcccccgtcggggtcctgntcgcttctctgctcagtctgcacncgctcctgaccntctctcggcctcgagctgagntgggagtctgattattactgttgactctatatgcaacgggcgttaccgtcgttgggtcggtcggcgggttaggaccgaagcgtcgacccgtcgttacggtcaacgtaaccccg

SEQ ID NO: 443190 - DNA, 643 bp, Homo sapiens
  misc_feature: GZ8MTXP01CYUQZ.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactgaaccngcagtgattgttggtggttatgtactttgtctcctggtaccaacagcagccgaggccgaaacgcccccaaattccatgtatttatgatgtcagtgcgccggcccccgtcgggggtcctgctcgtccttctcgtcgtcctccaacgtctgggccaaccgtaccggcccttcccgtcgaccctagttccctcgtcggccctcccgagcccgtaggacggtattggggacgggtcttaggtaactttattacgttggtttcgtaccttctaattagttcggccgtaacggggtccgggttacccggtcgggttttcgggggttacgggtttcccgggggcggggttaacggggttaccccggtaaggtccggtccgggtacccggttccggttacgggtcccgaacggtaacccccggg

SEQ ID NO: 443191 - DNA, 502 bp, Homo sapiens
  misc_feature: GZ8MTXP01D2I48.10.59.F04.1.454.CMB.2.raw
  modified_base (229)..(229): a, c, t, g, unknown or other
  modified_base (372)..(372): a, c, t, g, unknown or other
  modified_base (434)..(434): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagccctcgctcagtgtccgggtctcctgggcagtcagtcaccatctcctgcactggaaccngcagtgatgtggtggttatgacttgctctggtaccaacagcagccaggccgaagcccccaaattccatgatttatgatgtagtgcgcggccctccgggggtcctgactcgcttctctggctccaagtctggcacacgcctccngaccatctctcggcctccagcctgagatgaggctgactttattctgttgctcatatgtacgnggcggtacgttcgttgggttcgttcgggcggagggcaaggctgaaccgtcgtgttacgcgccgaacgg

SEQ ID NO: 443192 - DNA, 550 bp, Homo sapiens
  misc_feature: GZ8MTXP01A3ZIP.10.59.F04.1.454.CMB.2.raw
  modified_base (228)..(228): a, c, t, g, unknown or other
  modified_base (234)..(234): a, c, t, g, unknown or other
  modified_base (266)..(266): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtnatgttggtgttatgtacttgctctgtaccaanagcagccaggcgaacgcccccaattcatgatttatgatgtcagtgcgcggcccccgtcgggggtcctgctcgcttctcgtcggctccagtctcggctaaacgccgccctccctgaccctatctccgtcggtcctccagtccctggacggtagtggggacgggtctgtaatttacttacgtgttcgtctctatagtcgcgaaggtcggttaccgtcggttgggtggttcggggcggttagggaccaaggtccgtaagtcccggtcgttacggtccgcgtaacccg

SEQ ID NO: 443193 - DNA, 640 bp, Homo sapiens
  misc_feature: GZ8MTXP01DUD48.10.59.F04.1.454.CMB.2.raw
  modified_base (304)..(304): a, c, t, g, unknown or other
  modified_base (311)..(311): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagccctcctcactcagggcacaggatcctgggctcagtctgccctgactcagcctcgctcagtgtccgggtctccgtgggcagtcagtcaccatctcctgcactgaaccagcagtgattgttggtgttatgtactttgctctgtaccaacagcagccaggcgaacgccccaaatcatgtatttangtatgtnagtcgcggccggtcccccgtcgggggtcctgactccgtcttccgtcgtcggtcctaccgtaacgtcgtacgggaccaaacccgtcccgggtccccttacccgtacgaccctacttcctccgttccgggccccttcccgacgtccccgtagggaacgggcgttcggggaacggtcgttaaggtaattttaacgtttaccgttgtttacggtccttaccgtaattagtcggaccggtaacgggtccggttaccggtcggttggggtcggttcggggacggttaggggaccaaggtcgtaacggacccgtcgttacggtccgaacgaacccg

SEQ ID NO: 443194 - DNA, 596 bp, Homo sapiens
  misc_feature: GZ8MTXP01A80K1.10.59.F04.1.454.CMB.2.raw
  modified_base (485)..(485): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccatcaccatctcctgcactggacccacagttacattggtaaataatgaatatgtctcctggtaccaacagtacccaggacaaacgcccccaaatgatgtattatgatgtacagtaactcgaccctcgtaggggtttctgatcgtctttcttcgaccctcctaagtctcgggaccaacgacggtccctccctcgaccctattcctcgtcgggcctacccgaagaccgtggaacggacgagggtctagtacttagttactgacagcctcaacactaacgagccggngtaacgggtcggggttgggtcgggttccgggggaccggaccgtaccgacggttccgttccgttacggtccgcgaaccgaccggacgttccgtccccgttcccggttaaccg

SEQ ID NO: 443195 - DNA, 513 bp, Homo sapiens
  misc_feature: GZ8MTXP01DYN1H.10.59.F04.1.454.CMB.2.raw
  modified_base (366)..(366): a, c, t, g, unknown or other
  modified_base (506)..(506): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctgctcagtgtccgggtctcctggcagtcagtcaccatctcctgcactggaaccagcagtgattgtggtggttatgtacttgtctctggtaccaacagcagccaggcgaacgccccaaattcatgatttatgatgtcagtgcgccggtcccccgtcgggggtcctgactcgcttctctggctccagtctggcaacncgcctcctgaccatctctggcctcgacgcctgacgatgggaggtcttgtattatcgtgtttgcttctatatcgcgaagggtcggttcgtcgtttgggtgttcgggcggcgggaccaagctcgaccgtccgttaggtccgngaacccg

SEQ ID NO: 443196 - DNA, 692 bp, Homo sapiens
  misc_feature: GZ8MTXP01AKJR0.10.59.F04.1.454.CMB.2.raw
  modified_base (226)..(226): a, c, t, g, unknown or other
  modified_base (304)..(304): a, c, t, g, unknown or other
  modified_base (338)..(338): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcacatctctgcactggaaccngcagtgattggttggtggttatgtactttgtctcgtggtaccacagcagccaggccaacgccccaaatcatgtattangatgtcagtcgcgccggtcccccgtcggggtccngtctcgtcttctcgtagcctcgagtctcggacaaacgcccgtccctcccgtagaccctacttcccgtccgtccgggtccccttaccgaccggtcccgttagggaaccgggtagtcgggggtaacggtccgttaggttaaacttttaaccgtttagtcgtttcggtaccttaactagttaaccggtcggaccggtaaccgggggttacccgggtttacccgggttcgggtttcggggggtttccgggtttaccggggggacccggggttaaaccgggacccggtaaaacgggtcccggttaaccgggaccccggtttaccgggttacgggtaacccgaacccgggtaaccccggg

SEQ ID NO: 443197 - DNA, 498 bp, Homo sapiens
  misc_feature: GZ8MTXP01AC543.10.59.F04.1.454.CMB.2.raw
  modified_base (225)..(225): a, c, t, g, unknown or other
  modified_base (242)..(242): a, c, t, g, unknown or other
  modified_base (298)..(298): a, c, t, g, unknown or other
  modified_base (377)..(377): a, c, t, g, unknown or other
  modified_base (379)..(379): a, c, t, g, unknown or other
  modified_base (395)..(395): a, c, t, g, unknown or other
  modified_base (423)..(423): a, c, t, g, unknown or other
  modified_base (458)..(458): a, c, t, g, unknown or other
  modified_base (471)..(471): a, c, t, g, unknown or other
  modified_base (490)..(490): a, c, t, g, unknown or other
tcagcatagtagtgcacgaccggtgctcgatttagtacacacacttagggattggggggtctcaggaggcagcactctcgggacgtctccaccatggcctgggctctgctcctcctcagcctcctcactcagggcacaggatcctgggctcagtctgccctgactcagcctgctcagtgtccgggtctcctgggcagtcagtcaccatctcctgcactggaaccngcagtgatgtgtgttangacttgctctggtaccaacagcagccaggcgaaacgcccccaaattcatgatttangatgtcagtcgcgcggcccccgtcgggggtcctgactcgtcttctctggcctcagtctggcacacgcctcctgccatcncncgcctccagcctgagntgggaggtctgtatttatactgtgcctntatgtgcgaaggtcgttcgtcgttgggtgtcgggngagggcaaggtcnggtaccgtcgttacggtcngaaccccg

SEQ ID NO: 443198 - DNA, 686 bp, Homo sapiens
  misc_feature: GZ8MTXP01BD36Z.10.59.F04.1.454.CMB.2.raw
  modified_base (227)..(227): a, c, t, g, unknown or other
  modified_base (266)..(266): a, c, t, g, unknown or other
  modified_base (299)..(299): a, c, t, g, unknown or other
  modified_base (305)..(305): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctctgcactggaaccngcagtgatgttggtgttatgacttgctctggtaccaacngcagccaggcgaacgccccaatcatgtatttangatgtnagtgcgccggcccccgtcgggggtcctgctcgtcttctcgtcggctccacgtcgtcggacaaccgtacccggccctcccgtcgaccctacttcccgttccgtccggtcccttaccgacgtcccgtaggaacgggtaacgttgggggaacggggttacctttagggtaactttttaaacgttccgttggttttccggtaccttacgtaagttaacgttcggccggtaaacgggggttccccggggttaccggttccggggtttggggggttaccgggttcccggggggaccgggggttaaccggggaacccgtaacggggtcccgttccggggtaaccccgggttccggttaacggggttcccgaaccgggtaacccccggg

SEQ ID NO: 443199 - DNA, 659 bp, Homo sapiens
  misc_feature: GZ8MTXP01B21OD.10.59.F04.1.454.CMB.2.raw
  modified_base (228)..(228): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgattgttggtgttatgtactttgtctcctggtaccaacagcacgccgaggcgaacgacccccaaattcatgtatttatgatgtcagtggcgcggcccccgtcgggggtcctgactcgtcttcgtcgtggcctaccgagtcgtcggaccaaccgaccggtccctcccgtacgacctacttccgtcctcggccctacccgacgtcccgtaggacggtacgttaggggacggttccgttagttaaacttttacgtttaccgttggtttccgtacttacgtaagttacgtcggaccggtaacgggggtacccggtttacccggtcggggttttcggggttcgggttccggggacggggttaccgggttaacccgtaaggtccgtaaccggtcccggtaccggttacgggttaaccgaaccggtaaccccg

SEQ ID NO: 443200 - DNA, 681 bp, Homo sapiens
  misc_feature: GZ8MTXP01A33VI.10.59.F04.1.454.CMB.2.raw
  modified_base (275)..(275): a, c, t, g, unknown or other
  modified_base (314)..(314): a, c, t, g, unknown or other
  modified_base (320)..(320): a, c, t, g, unknown or other
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcaccatcctcctgcactggaaccagcagtgattggttggtggttatgtactttgtctcctggtaccaanagcagccgaggaccgaacgccccaaattcatgtatttangatgtnagtcgcggccggtcccccgtccggggtcctgactcgtcttcgtcgtgcctaccgtacgtcgtacggaccaaccgacccgtccctcccgtacgacctactcctcgtcggccctccgacgtcccgtaggacggtacgtcggggtacggtcgttacgttactttaacgttccgttggtttcgtacccttacggtattaacgtcgggtacgtaaccgggggttaacccgggttaccgggtcggggtttcgggggttaccggggtttaccgggggaccgggggaacggggttaacccgtaacgggtcccgggttaaccggtaccccgggtaccgttacgggtaacccgaaccgggtaacccccggg

SEQ ID NO: 443201 - DNA, 669 bp, Homo sapiens
  misc_feature: GZ8MTXP01BJRUK.10.59.F04.1.454.CMB.2.raw
  modified_base (226)..(226): a, c, t, g, unknown or other
tcagcatagtagtgcacgaccggtgctcgatttagtacacacacttagggattggggggggtctcaggaggcagcactctcgggacgtctccaccatggcctgggctctgctcctcttcagcctcctcactcagggcacaggatcctgggctcagtctgccctgactcagcctcgctcagtgtccgggtctccgtgggcagtcagtcaccatctctgcatggaacngcagtgatgtgtgtatgtacttgtctctgtaccaacagcagccaggcgaacgacccccaaatcatgtatttatgatgtcagtgcgccggcccccgtcgggggtcctgactcgtcttcgtctaggtcctccaacgtcgtcggacaaccgaccggccctccctcgaccactcctccgtcggccccttcccgacgtccgtaggaaacgggtcgttacgggggaaggtccgttaaggtaattttaacgttaccgttggtttcggtaccttcctaagtttacgtcggtccggtaacgggtccggggttacccgggttccgggtttacgggggttcggggtttcccgggggaccgggggttaacggggttaaccccggtaaacgggcccgttaaccgggtaaccccggttacccgttacggggtaacccgttaaccggtaacccccggg

SEQ ID NO: 443202 - DNA, 623 bp, Homo sapiens
  misc_feature: GZ8MTXP01BOVFY.10.59.F04.1.454.CMB.2.raw
  modified_base (230)..(230): a, c, t, g, unknown or other
  modified_base (273)..(273): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctggactcagtctgccctgactcagcctcgctcagtgtccgggtctccgtggcagtcagtcacctatcctcctgcactggaaccngcagtgattggttggtggttatgtactttgctcctgtaccaanagcagccaggaccgaaacgccccctaaatcatgtatttatgatgtcagtcgcgccgggtcccccgtcgggggtcctgctcgtcttctcgtgcctacagtctcggacaaccgccggtccctccgtacgaccctacttcccgtccgtcggtcccctccgacggtccgtagggaacgtcgtacgggggacgtcgttagtaacgttttaacgttcgttcgttacgtccttactaagttacgtcggtaccggtaacgggtccggttaccggtcggtttcgggggtcggttccggggacgggttacggaaccgtaagtccggtaacgtacccgtcgacggtccgccggtaacccgg

SEQ ID NO: 443203 - DNA, 601 bp, Homo sapiens
  misc_feature: GZ8MTXP01AKYOM.10.59.F04.1.454.CMB.2.raw
  modified_base (239)..(239): a, c, t, g, unknown or other
  modified_base (243)..(243): a, c, t, g, unknown or other
  modified_base (265)..(265): a, c, t, g, unknown or other
  modified_base (306)..(306): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggatacccctgtccctcagttgcgctgtctcgtggtgctcatcaangtgngacacgtggtgggctgggtccnccacgcccccgagggatgggactggagtggattggccttanactattagtagtcggacctacccactaccaacccgtcctacgaggacgtcgagtcaaccatctacactagacacgtcaagactcactctctgcgtcactctgcgaccgccgacgacgacggcggttagtactttagtgtcgcgtacgaccgaccccgtgttaacgaacgttacttccctaataaacgtttcgttaaaccgtttcggaacccgttaaccgggttggggggcccaacggggggtccctccccggttaacgggtccctaacccggttcctcccgttccgtaaccccgg

SEQ ID NO: 443204 - DNA, 647 bp, Homo sapiens
  misc_feature: GZ8MTXP01B3QUC.10.59.F04.1.454.CMB.2.raw
  modified_base (228)..(228): a, c, t, g, unknown or other
  modified_base (302)..(302): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagccctcctcactcagggcacaggatcctgggctcagtctgccctgactcagcctcgctcagtcgtccggtctccgtgggcagtcagtcaccatctctgcactgaaccngcagtgatgtgtgtatgtacttgctctgtacaacagcacgcgaggacgaacgaccccctaaatcatgtatttangtatgtacagtcgccgccggtcccccgtcgggggtcctgactcgtcttctcgtcggcctaccgagtcgtcggaccaaaccgcccggtccctcccgtacgacctacttccgtccgtcggtcccttaccgacggtcccgtagggaacggtacgtacgggggtaacggtccgtttaggttaacttttaacgtttaccgttggtttcgtacttactaagttacgttcgggacggtaacggggttcccggttaccggtcgggtttcggggttacggggttcggggacggggttacggaccgtaacggtccggttcgtacccggtcgttaacggtccgaacggtaaccccg

SEQ ID NO: 443205 - DNA, 648 bp, Homo sapiens
  misc_feature: GZ8MTXP01DFQXY.10.59.F04.1.454.CMB.2.raw
tcagcatagtagtgcacgaccggtgctcgatttagtacacacacttagggattggggggggtctcaggaggcagcactctcgggacgtctccaccatggcctgggctctgctcctcctcagccctcctcactcagggcacaggatccgtgggctcagtctgccctgactcagcctcgctcagtgtccgggtctccgtgggcagtcagtcaccatcctctgcactggaaccagcagtgattggttggtggttatgtactttgctctcggtaccaacagcacgccaggaccgaaacgaccccctaaattccatagtatttatgaatgtcagtcgcgccggtcccccgtcgggggtcctgtactcgctttctcgtacggctaccgaagttccgacgggacaaacccgacccggtcccttacccgtcgaccctacttccgtcctcggcccttacccgacgtcccgttaggaacgggtaatggggacggtcctaggttaaagtttactttaacgttggttgtaccctataaagttagcgtacggaacgggtccgggttacccgtgggttacggggttcgggttccgggacgggcgggaaccgtaaggccgttcggtaaccccgtcggttaggttcccgaaccgggtaaccccg

SEQ ID NO: 443206 - DNA, 531 bp, Homo sapiens
  misc_feature: GZ8MTXP01CVFUL.10.59.F04.1.454.CMB.2.raw
  modified_base (229)..(229): a, c, t, g, unknown or other
  modified_base (245)..(245): a, c, t, g, unknown or other
  modified_base (251)..(251): a, c, t, g, unknown or other
  modified_base (458)..(458): a, c, t, g, unknown or other
tcagcatagtagtgcacgaccggtgctcgatttagtacacacacttagggagttgggggggtctcaggaggcagcactctcgggacgtctccaccatggcctgggctctgctcctcctcagccctcctcactcagggcacaggatcctgggctcagtctgccctgactcagcctcgctcagtcgtccgggtctccgtggcagtcagtcaccatctcctgcactgaaccngcagtgatgtgtgtangtattnctctgtacaacagcagcaggacgaacgcccccaaattcatagatttatgatgtcagtgcgcggccccgtcgggggtcctgactcgcttctctggctcctaagtctcggacaacacggccctccctcgaccctatcctcgtcggtcctccgacgtccgtgacgtagtgggagggtctggtatttaacgttctgttcgcttctagttancgtcgaaggtccgttacgtcgttgggtcgtcgggcggcggactaacgcgtcgaccgtcacggtcgaacgcccg

SEQ ID NO: 443207 - DNA, 668 bp, Homo sapiens
  misc_feature: GZ8MTXP01DUFAT.10.59.F04.1.454.CMB.2.raw
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgggcagtcagtcaccatctctgcactggaaccagcagtgattgttggtgttatgtactttgtctcctggtaccaacagcacgccgaggaccgaaacgaccccctaaattccaattagtatttatgtatgtctagtcgcggccggtccccccggtcgggggtcctggacgttccgtcttctcgtcggtcctaccgtaagtccgtacggaccaaacccgcccggtccctcccgttacgaccctacttccgtccgtccgggtaccctccgacgtcccgttggacggtaagtcgggggaacggttcgttaggtttaactttaacgttacgttcgggttctacttactagttagttcggacgggttaacgggtccggttacggtcgggtttcgggggttcggttcgggggaccgggttacgggaaccgtaaggtccgtaacggtcccgtaccggttcgtaaccgccggtaaccccgg

SEQ ID NO: 443208 - DNA, 662 bp, Homo sapiens
  misc_feature: GZ8MTXP01AGQBV.10.59.F04.1.454.CMB.2.raw
  modified_base (268)..(268): a, c, t, g, unknown or other
  modified_base (284)..(284): a, c, t, g, unknown or other
  modified_base (303)..(303): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggcagtcagtcacatctctgcactgaatcagcagtgatgttggtgttatgtacttgtctcctaggtaccaacngcagccgaggcgaacnccccaaatcatgtatttangatgtcagtcgcgccccggtcccggtcggggtccctgactcgtcttcgtcgtggcctccgaagtcgtcggaccaaccgaccggtcccctcccgtcgaaccctcgttcccgtccgtccgggtccccttccgacgtccgttagggaacggtacgttcggggaacggtccttaggttaactttagtttacccgttggtttcgtccttaccgtaagtttacgtcgggtaaccggtaacggggttccccggggtttaccccggttgggttttacgggggttcggttcccgggggacgggaaccggggtaaccgtaacgggtcccgtacgggtaccccgttccgttaacgggcccgtaacccggg

SEQ ID NO: 443209 - DNA, 647 bp, Homo sapiens
  misc_feature: GZ8MTXP01BDGBC.10.59.F04.1.454.CMB.2.raw
  modified_base (234)..(234): a, c, t, g, unknown or other
  modified_base (268)..(268): a, c, t, g, unknown or other
tcagcatagtagtgcacgaccggtgctcgatttagtacacacacttaggggagttgggggggggtctcaggaggcagcactctcgggacgtctccaccatggcctgggctctgctcctcctcagcctcctcactcagggcacaggatcctgggctcagtctgccctgactcagcctcgctcagtcggtccgggtctccgtgggcagtcagtcaccatcctctgcactggaaccngcagtgatgtgtgtatgtacttgctctgtacaangcagcaggcgaacgccccaattcatgtatttatgatgtcagtcgcggccggtcccccgtcgggggtcctgctccgtcttctcgtcggtcctccgtaacgtccgtacgggaccaaaccgtcccgtccctccgtacgaacctcgtccgtcgtcggtaccctccgaacgtccgtaggacggtacgtcggggaacggttccttagttaacgttttactaccgtttggttacgtaccttacgtaagtttacgacggtccgggtaacggggttacccgggttccgggttccggttggggttacgggtccgggaaccggggacggttaaccgaacggtccgtaacgggtacccgttacggttaaccgggttcgaaccggtccccgg

SEQ ID NO: 443210 - DNA, 657 bp, Homo sapiens
  misc_feature: GZ8MTXP01EXKOY.10.59.F04.1.454.CMB.2.raw
  modified_base (227)..(227): a, c, t, g, unknown or other
  modified_base (267)..(267): a, c, t, g, unknown or other
  modified_base (297)..(297): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccggtctccgtggcagtcagtcaccatctcctgcactggaaccngcagtgattgttggtgttatgtacttgctctggtaccaangcagcagcaacgccccaatcatgtatttangtatgtcaggtcgccggccggtcccccgtccggggggtcctaggtacgttccgtccttcgtccgtcgggaccttcccgtaagttccgtacgggacctaaacccgtacgggtcccctacctacggaccctacgttcctccgtcggtaccccttaccgaggtccccgttaggacgggtacgttcgggggaacggttcctaggttactttaacgttgtcggttcctcgtcttactacgttaagtcggcgtaacggggttccggtaccccggtttgggttaccgggttacgttcgttccggttaccgggtaaccggtcggggtaaccctcggggtacccttaccgggtccgtttcgggaacccg

SEQ ID NO: 443211 - DNA, 668 bp, Homo sapiens
  misc_feature: GZ8MTXP01CAK6U.10.59.F04.1.454.CMB.2.raw
  modified_base (209)..(209): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcggcccaggactggtgaggccttcggactaccctgtccctnagttcgcgctgtctctggtgctcatcaacagtggtgacacgtggtgggctgggtccgcgacgcccccgagggactgggacgtggaggtggtacgttcggccttacactaatttagtacggtcgggaacctaccccgaactaccaaccccgtccctaccgaggacgtcgagtccaaccatcctacactacgacacgtaccaggaactcctacctcctcccgtacggacggttcaacccgttcgtacgtcgaccccggcccggaccgggaccgaccgggttacccgggtagtttaactttacgttacggtcgaccggacgtaccgacccccggtagttacgaacgttacttccctaacgtaacgttacgttactttcggaaacccgtcggttccgggggccgaacgggggccgtaccccggttcggtacccgtaccgttcccgtcccgttcgtaacccccg

SEQ ID NO: 443212 - DNA, 702 bp, Homo sapiens
  misc_feature: GZ8MTXP01EXETO.10.59.F04.1.454.CMB.2.raw
  modified_base (207)..(207): a, c, t, g, unknown or other
  modified_base (225)..(225): a, c, t, g, unknown or other
  modified_base (306)..(306): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccggtctcgtggcagtcagtcacntctcctgcactggaaccngcagtgattgttggtgttatgtactttgtctcgtgtaccaacagcacgccaggaccaacgaccccaaattcatgtatttangatgtcagtcgccggccggtcccccgtcgggggtcctgtactccggtcttcgtcgtcgggtccctccgtaacggttccgtacgggaccaaacccgtcccgggtaccccttccccgttacggaaccctacgttcccgttaccgtccgggtccccttaccgaaccgtccgtagggaacggtgtacggggggtacgggtaccttagttaacttttacgttacgttcgtttacgccttacgtagtttaacgcggtaccggtaaacggggttcccggttaacccgggttcgggtttcgggggtcgggtttccggggacggggttaacggggttacccaacggggttccgtaaccgggttcccggtaccgttacggggaacccgttaacccgggtaacccgg

SEQ ID NO: 443213 - DNA, 701 bp, Homo sapiens
  misc_feature: GZ8MTXP01DEZ8I.10.59.F04.1.454.CMB.2.raw
  modified_base (276)..(276): a, c, t, g, unknown or other
  modified_base (322)..(322): a, c, t, g, unknown or other
  modified_base (325)..(325): a, c, t, g, unknown or other
  modified_base (331)..(331): a, c, t, g, unknown or other
  modified_base (416)..(416): a, c, t, g, unknown or other
  modified_base (421)..(421): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtgggcagtcagtcaccatctcctgcactggaaccagcagtgagttgttggtgttatgtacttcgtctcgtcgtaaccaancgacacgcgacggaccgaaccgtacccctaattcaatagtatttangtntgtcgngtcgcggccggtccccggtccgggtctgtctccgtcttcgtcgtcgtcctactgtcgtcggacgtaccgcccgtccctaccgtanacctnttccgtacgtcggccctacgcgtcgaggacgtacgttaggggacgttcttaagttacgtttacgttacgtcggtttacgtaacttactaaaggttaccgtccggggtaaaccggggttaacccgggggtttccgggttttacccggggtttacgggggttttgggggtccggggttaacccggggggaaccggggttaaccgggaaaccgtcgggtacccgttaaccggggttaaccccgttccgggttaacggggttcccgaacccgggtaaccccggg

SEQ ID NO: 443214 - DNA, 656 bp, Homo sapiens
  misc_feature: GZ8MTXP01CJCK5.10.59.F04.1.454.CMB.2.raw
  modified_base (213)..(213): a, c, t, g, unknown or other
  modified_base (244)..(244): a, c, t, g, unknown or other
  modified_base (506)..(506): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggcggccccagatgggtcctgtcccagctgcagctgcatgagtcgggcccaggactggtgaggcctttcggacttacccctgtcccctnagttgcgctgtctcgtggtgctccatcaacnggtggtgacaacgtgggtggggcgtcgggtcccgcccgacggccccccgaggggagtggggactgggaggtggatttggccttacactattagtaggtggacctacccactaaccaaccccgtccctccgaggacgtcgacgtcaaacccatcctcaactagacacgtaccaggaaactccacctcctaccgtgacggtcgacctcgtgtcgacccgccgacggacacggtccgtgtactttagtgtgcgagacgaccccgntacggaactcttccctaactaaatttacgggtttaccttttacgggaaaccccgtacgggttacggggggaccccgttacgggggtaacccggtccccggttcgggttccccgtaacccgggtttccttaaccccgttcgtaacccccgg

SEQ ID NO: 443215 - DNA, 594 bp, Homo sapiens
  misc_feature: GZ8MTXP01A8EUX.10.59.F04.1.454.CMB.2.raw
  modified_base (228)..(228): a, c, t, g, unknown or other
  modified_base (310)..(310): a, c, t, g, unknown or other
  modified_base (553)..(553): a, c, t, g, unknown or other
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggcagtcagtcacatctcctgcactggaaccngcagtgattgttggtgtatgtacttgctctaggtaccaacagcagccaggacgaacgaccccctaaattcattagtatttangatgtcagtcgcgccggtccccgtccgggggtctgactcgtcttctcgtcggcctccgaagtcgtacggacctaaaccgccggtccctcccgtcgaccctacgtctccgtcggtccctccgacgtcccgaggaggtacgtcggggagtaccgttgtactttaagttccgttgttggtctactagttagtcgcgaacgggtcgttacggtggttcgggtacggtcggggacgggcgggttaccncggtcgtcgtaccggtcttaacgggtccaacgtaaccccgg

SEQ ID NO: 443216 - DNA, 521 bp, Homo sapiens
  misc_feature: GZ8MTXP01AJAN8.10.59.F04.1.454.CMB.2.raw
  modified_base (225)..(225): a, c, t, g, unknown or other
  modified_base (274)..(274): a, c, t, g, unknown or other
  modified_base (293)..(293): a, c, t, g, unknown or other
  modified_base (366)..(366): a, c, t, g, unknown or other
  modified_base (500)..(505): a, c, t, g, unknown or other
  modified_base (507)..(521): a, c, t, g, unknown or other
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagacgacccccgntgaagtattcctacaattgtactttgacccacgtgggggccaggggacnccctggtccaccgtctccncacgccctccaccgaacgggccccagtccggtcccttccccccgtgggcccgcccctcgcctcccgagggacncccacccgtccggagacgccacgacggcccccggcccgtgggcctcggcccgtaagggtcaacgggtccctacccgttcccacttactagtcgactggacgtccggggactgggaccgaagggcccagataggnnnnnngnnnnnnnnnnnnnnn

SEQ ID NO: 443217 - DNA, 614 bp, Homo sapiens
  misc_feature: GZ8MTXP01D1ZU3.10.59.F04.1.454.CMB.2.raw
  modified_base (230)..(230): a, c, t, g, unknown or other
  modified_base (267)..(267): a, c, t, g, unknown or other
  modified_base (308)..(308): a, c, t, g, unknown or other
  modified_base (501)..(501): a, c, t, g, unknown or other
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctgccctgactcagcctcgctcagtggtccgggtctccgtgggcagtcagtcaccatctcctgcactgaaccngcagtgatgtggtgtatgtacttgctctgtaccaacngcagcaggacgacgacccctaattcatagtattatgatgtngtcgcggccggtcccccgtccgggggtcctgtacgtccgtccgttctcgtcgggtaccctacccgtaaacgttcgtacgggaccaaaccgacccgggtcccttaccccgtcgaaccctacttccgtcgtcgggtccctccgacgtacccgtgggaacgcgtaggggagtcttaagtatttattacgtggttcnctctattacgtgcgaacgggtccggttaccggtcggtttaggggttcgggtccgggacgggttcgggaaccgaaggtcgtcgtaccgtcgttacggtccgaacggtaacccgg

SEQ ID NO: 443218 - DNA, 616 bp, Homo sapiens
  misc_feature: GZ8MTXP01A4RNZ.10.59.F04.1.454.CMB.2.raw
  modified_base (208)..(208): a, c, t, g, unknown or other
  modified_base (223)..(223): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcaggcacaggatcctgggctcagtctgccctgactcagcctcgctcagtcgtccggtctccgtggcagtcagtcacntctctgcagtgaacngcagtgtattgtggtgttatgtacttgtctctacggtaccaacagcagccaggccgaacgacccctaaagtcatgtatttatgtatgtcagtcgccgccggtccccgtcggggtcctggtactcgtcttccgtcgtcgtctaccgtacgtccgtacggaccaaaccgtccggtccctccggtacaccgtattccgtccgtcggtaccctccgtacgtacccgtagggagtacgtacggggtacggtccttaaggtacctttagtaccgttgttaccgtcgtacctaattcgtcggacgtaacgggtccgttcggtccggttagggtccggttacgggacggttacgaccggtaagtccgtaacgtcgtaccgttacgtccgaaccgtaacccg

SEQ ID NO: 443219 - DNA, 534 bp, Homo sapiens
  misc_feature: GZ8MTXP01AU5GE.10.59.F04.1.454.CMB.2.raw
  modified_base (225)..(225): a, c, t, g, unknown or other
  modified_base (289)..(289): a, c, t, g, unknown or other
  modified_base (344)..(344): a, c, t, g, unknown or other
  modified_base (365)..(365): a, c, t, g, unknown or other
  modified_base (381)..(381): a, c, t, g, unknown or other
  modified_base (490)..(490): a, c, t, g, unknown or other
  modified_base (493)..(493): a, c, t, g, unknown or other
  modified_base (495)..(499): a, c, t, g, unknown or other
  modified_base (501)..(519): a, c, t, g, unknown or other
  modified_base (521)..(534): a, c, t, g, unknown or other
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagacgacccccgntgaagattcctcaatgtactttgacctacgtggggccagggacgccctggtccaccgtctcccncacgccctccaaccgaacgggcccccagtcccggttccttccccccgtgggcccnccccgtgccctccgaggaccncaccccgtccgaagcnccacgacggcccccggccctgggggcctcgccgtagggtacaacggtacctaccttccccaacgtactagtcgacctgacggccgggctcgggacaagggtcacgtaancgngnnnnngnnnnnnnnnnnnnnnnnnngnnnnnnnnnnnnnn

SEQ ID NO: 443220 - DNA, 639 bp, Homo sapiens
  misc_feature: GZ8MTXP01BAO7P.10.59.F04.1.454.CMB.2.raw
  modified_base (211)..(211): a, c, t, g, unknown or other
  modified_base (228)..(228): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccntctcctgcactgaaccngcagtgatgttggtgttatgtacttgctctgtaccaacagcagcaggcgaacgaccccaatcatcgatttatgatgtcagtcgcgtccggcccccgtcgggggtcctgtactcgccttctcgtcggactccaacgtcgtacggaccaaacgcccggtccctcccgtcgtaccactcctccgtcggtccctaccgacgccctgggaaggtacgttgggggacggtaccttaggtactttaacgttcgtggtttctccgttacctattaacgttcggccggtaacgggtacccgggttccggtccggtttgggggtccgggtttccgggggacggggcgggttaaccggaacggttccgttaaccgggtaacccggttcccggttaaacggttcccgaacggtaacccccggg

SEQ ID NO: 443221 - DNA, 521 bp, Homo sapiens
  misc_feature: GZ8MTXP02JW2VF.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtggttatgactttgtctcctggtaccaacagcagccaggcgaagcccccaaattcatgatttatgatgtcagtgcgcggccccctcgggggtccctgactcggcttctctggctccagtctggcacacggccctccctgaccatctctcggcctccagccctgaggctgaggctgattattactgttgctcatatgcaggcggtacgcgtttggggtcgttcgggcgggtacgggaccgaaggcgtacggacccggtccgtaacggtccgacggaccccgg

SEQ ID NO: 443222 - DNA, 540 bp, Homo sapiens
  misc_feature: GZ8MTXP02FM20A.10.59.F04.1.454.CMB.2.raw
  modified_base (238)..(238): a, c, t, g, unknown or other
  modified_base (304)..(304): a, c, t, g, unknown or other
  modified_base (311)..(311): a, c, t, g, unknown or other
  modified_base (455)..(455): a, c, t, g, unknown or other
tcagcatagtagtgcacgaccggtgctcgatttagtacacacacttagggattggggctttctgagagtcatggacctcctgtgcaagaacatgaatcacctgtggttcttcctcctgctggtggcggccccagatgggtcctgtcccagctgcagctgcatgagtcgggcccaggactggtgaggccttcggatacccctgtccctcagttgcgctgtctctggtgctccatcaacngtgtgacaactggtggggctgggtccgccagcccccagggatgggactggagtggattggccttanacattanagtgggactacccactacaaccccgtcctcaggatcgagtcaccatctcactagacacgtccaggaaatcacctctccctgacggttgaccctctgtgaccgccgcggacacggccgtgtattattgtgcgagacgacccccgntagaagtacttcctactaattcgttaccttcgacctacgtcggggccgagggaacgtcccgtcggtaccacccgtctccctcacg

SEQ ID NO: 443223 - DNA, 426 bp, Homo sapiens
  misc_feature: GZ8MTXP02GWKEH.10.59.F04.1.454.CMB.2.raw
  modified_base (422)..(426): a, c, t, g, unknown or other
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccaggggagccctggtcaccgtctcctcagcctccaccaagggccccatcggtcttccccctggccgccctgctccaggagcacctccgagagcacagccggccctgggctgcctggtcaggctacttcccactactatgctgagcgggctggcaaggcgcatagnnnnn

SEQ ID NO: 443224 - DNA, 436 bp, Homo sapiens
  misc_feature: GZ8MTXP02F8548.10.59.F04.1.454.CMB.2.raw
  modified_base (413)..(413): a, c, t, g, unknown or other
  modified_base (424)..(424): a, c, t, g, unknown or other
  modified_base (430)..(436): a, c, t, g, unknown or other
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtcaccgtctcctcagccctccaccaagggccccatcggtccttccccctgggccgcccctgcctccagggacgccaccctccgagagcacagcccggccctgggctgcctggtcaggctactcccatactatgctgagcgggntgggcaaggcncatagnnnnnnn

SEQ ID NO: 443225 - DNA, 419 bp, Homo sapiens
  misc_feature: GZ8MTXP02J2JTB.10.59.F04.1.454.CMB.2.raw
  modified_base (418)..(419): a, c, t, g, unknown or other
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccatggggccaggggagcccctggtcaccgtctcctcagcctccaccaagggcccatcggtcttccccctggccgccctgctccaggacgcacctccgagagcacagccggccctgggctgctggtcaggctactcccatactatgctgagcggctggcaaggcgcatagnn

SEQ ID NO: 443226 - DNA, 522 bp, Homo sapiens
  misc_feature: GZ8MTXP02G7TKH.10.59.F04.1.454.CMB.2.raw
  modified_base (226)..(226): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccggtctcctgggcagtcagtcaccatctcctgcactggaaccngcagtgatgtggtgttatgacttgtctctggtaccaacagcagccaggcgaacgcccccaaattccatgtatttatgatgtcagtgcgcggccccgtcggggtcctgatcgcttctcgtgctccagtctggccaacgaccgccctccctgaccatctctcgccctcacgcctgacggatggaggctagtattattactgttcgctcatatgcgacggccggtacgtcgttcggggtcgttcgggacggacggaaccgtaaggccgtacggtaccgtcgttacggcacgtaacccgg

SEQ ID NO: 443227 - DNA, 527 bp, Homo sapiens
  misc_feature: GZ8MTXP02H85WD.10.59.F04.1.454.CMB.2.raw
tcagcatagtagtgcacgaccggtgctcgatttagtacacacacttagggattggggggtctcaggaggcagcactctcgggacgtctccaccatggcctgggctctgctcctcctcagcctcctcactcagggcacaggatcctgggctcagtctgccctgactcagccctcgctcagtgtccgggtctcctgggcagtcagtcaccatctctgcactggaaccagcagtgatgttggtggttatgactttgtctcctggtaccaacagcagccaggcgaagcccccaaattccatgatttatgatgtcagtgcgcggccccctcgggggtccctgactcgctttctctggctccgaagtctcggcaaccaccggcctcccgtgaccatcctctcggcctccagcctgacggatgaggtctagattattactgttgtctcatatgcaggtcgtaccgtcgttgggtcgttcgggcggtacggaccgaaggtccgtcggacccgttacgtacggtccacggacccgg

SEQ ID NO: 443228 - DNA, 533 bp, Homo sapiens
  misc_feature: GZ8MTXP02HV4XX.10.59.F04.1.454.CMB.2.raw
  modified_base (359)..(359): a, c, t, g, unknown or other
  modified_base (398)..(398): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtgttatgacttgtctctggtaccaacagcagccaggcgaacgcccccaaatcatgatttatgatgtcagtgcgcggccccgtcggggtccctgactcgcttctctgctcagtctgcacncgcctccctgaccatcctctcggcctccagcctagacgntggaggtctagtattattacgtgttcgctctatagtcgcgacgggcgttaccgtcggttcggggttcggttcgggacgggtacgggaaccgtaaggtcgttacggacccggtccgtaacgggtccacggacccgg

SEQ ID NO: 443229 - DNA, 500 bp, Homo sapiens
  misc_feature: GZ8MTXP02GJK5Y.10.59.F04.1.454.CMB.2.raw
  modified_base (227)..(227): a, c, t, g, unknown or other
  modified_base (304)..(304): a, c, t, g, unknown or other
  modified_base (388)..(388): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtggttatgactttgtctcctggtaccaacagcagccaggcgaagcccccaaattcatgatttangatgtcagtgcgcggccccctcgggggtcccctgactcgccttctcgtggctcagtctggcaacacgcctccctgaccatctcncgcctccacgcctgaggatggaggtctagtattatactgtgctcatatgcaggcgtacgcgttgggtcgttcggcggaggaccaagcgtacgccgtcgacggtcacgacccg

SEQ ID NO: 443230 - DNA, 502 bp, Homo sapiens
  misc_feature: GZ8MTXP02HNOJU.10.59.F04.1.454.CMB.2.raw
  modified_base (227)..(227): a, c, t, g, unknown or other
  modified_base (301)..(301): a, c, t, g, unknown or other
  modified_base (431)..(431): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtgtatgacttgtctcctgtaccaacagcagccaggcgaacgcccccaaattcatgatttangatgtcagtgcgcggcccccgtcggggtccctgactcgcttctctcggctccaagtctggaccaacgaccgccctccctgaccatctctcggcctcagcctgagatgaggtctgtattattactgtgctnatatgcacggcgtacgcgttgggtcgtcggcggagggaccaagctacggaccgtcgtacggccaacgcccg

SEQ ID NO: 443231 - DNA, 501 bp, Homo sapiens
  misc_feature: GZ8MTXP02F84ZD.10.59.F04.1.454.CMB.2.raw
  modified_base (260)..(260): a, c, t, g, unknown or other
  modified_base (292)..(292): a, c, t, g, unknown or other
  modified_base (330)..(330): a, c, t, g, unknown or other
  modified_base (413)..(413): a, c, t, g, unknown or other
tcagcatagtagtgcacgaccggtgctcgatttagtacacacacttagggattggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtggtgtatgacttgttctggtacanagcagcaggcgaagccccaaatcatgatttangatgtcagtgcgcggcctcggggtccctgatcgcttcnctggctcagtctggcaacacggcctccctgaccatctctcggcctcagcctgacgatcgaggctgattatactgtgctcaatntgcaggcggttaccgcgtttggggtcgttcgggacggtacggggccaaaggccgttggaacccgtcgtaggtccacggccccaaaggg

SEQ ID NO: 443232 - DNA, 555 bp, Homo sapiens
  misc_feature: GZ8MTXP02JCCU3.10.59.F04.1.454.CMB.2.raw
  modified_base (229)..(229): a, c, t, g, unknown or other
  modified_base (309)..(309): a, c, t, g, unknown or other
  modified_base (370)..(370): a, c, t, g, unknown or other
  modified_base (383)..(383): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgggcagtcagtcaccatctcctgcactgaaccngcagtgatgttggtgttatgtacttgtctctggtaccaacagcagccaggccgaaacgcccccaaattcaatgtatttangatgtcagtgcgcggcccccgtcggggtcctgactcgcttctcgtcgctcagtctgacacncgcctcctgaccntctctcggcctccgacgcctgagatggacggtctaggtatttattacgttgttcgcttacagttagtcgacgtacgggtccgtaccggtcggttcggggttcggttccggggacgggtacggaaccgtaacggtcgtacggacccgttcgtaacggtccgacgtaaccccgg

SEQ ID NO: 443233 - DNA, 430 bp, Homo sapiens
  misc_feature: GZ8MTXP02GSISU.10.59.F04.1.454.CMB.2.raw
  modified_base (426)..(430): a, c, t, g, unknown or other
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccaggggagccctggtcaccgtctcctcagcctccaccaaggccccatcggtcttccccctggccgcccctgcctccaggagccacctccgagagcacagcccggccctgggctgcctggtcaggcctacttcccactactatgctgagcgggctggcaaggcgcatagnnnnn

SEQ ID NO: 443234 - DNA, 501 bp, Homo sapiens
  misc_feature: GZ8MTXP02F944X.10.59.F04.1.454.CMB.2.raw
  modified_base (300)..(300): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtggtggttatgtacttgtctctggtaccaacagcagcaggcaagacccccaattcatgattangatgtcagtgcgcggccccgtcggggtcctgactcgcttctctgctcagtctgcacaccgcctccctgaccatctcgtcggcctccacgcctgacggatgaggctgtatttattacgtgttcgctcatagtgcacggcgtaccgcgttggggtcgtcgggacggaggaccaagcgtacgacccgtcgtacggcacgacccg

SEQ ID NO: 443235 - DNA, 506 bp, Homo sapiens
  misc_feature: GZ8MTXP02IIMZ9.10.59.F04.1.454.CMB.2.raw
  modified_base (227)..(227): a, c, t, g, unknown or other
  modified_base (403)..(403): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagccctcctcactcagggcacaggatcctgggctcagtctgccctgactcagcctgctcagtgtccgggtctcctgggcagtcagtcaccatctcctgcactggaaccngcagtgatgttggtggttatgactttgtctcctggtaccaacagcagccaggcgaagcccccaaattccatgatttatgatgtcagtgcgcggcccctcgggggtccctgatcgcttctctggctccagtctggcaacacgcctccctgaccatctctcggcctccagcctgaggntgaggctgattattactgttgctcatatgcaggcggtaccgcgtttgggtcgttcgggacgggtaggaccgaagcgtcgaccgtccgtacggtcagtaccccg

SEQ ID NO: 443236 - DNA, 545 bp, Homo sapiens
  misc_feature: GZ8MTXP02GYO4V.10.59.F04.1.454.CMB.2.raw
  modified_base (226)..(226): a, c, t, g, unknown or other
  modified_base (300)..(300): a, c, t, g, unknown or other
  modified_base (359)..(359): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccggtctcctgggcagtcagtcaccatctcctgcactggaaccngcagtgatgttgtgtatgacttgtctcctggtaccaacagcagccaggcgaaacgcccccaaattcatgattangatgtcagtgcgcgccccgtcggggtcctgactcgcttctcgtgctcagtctggcaacncgcctcctgaccatctctcggcctccagcctgacggatgacggtctagtatttagttacttggttctctactatagtcgcgtaacgggtccggttaccgcggtttcggggtcggttccggggaccgggagggtacccgaaggtccgtacggtacccgttccggtaacggtccgacggaacccccgg

SEQ ID NO: 443237 - DNA, 517 bp, Homo sapiens
  misc_feature: GZ8MTXP02H9OZN.10.59.F04.1.454.CMB.2.raw
  modified_base (372)..(372): a, c, t, g, unknown or other
  modified_base (439)..(439): a, c, t, g, unknown or other
  modified_base (442)..(442): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagccctcgctcagtgtccgggtctcctgggcagtcagtcaccatctcctgcactggaaccagcagtgatgttggtgttatgacttgtctcctgtaccaacagcagccaggcgaacgcccccaaattcatgatttatgatgtcagtgcgcggccccgtcggggtccctgactcgcttctcgtcggtctccgaagtctcggcaaacnccggccctccctgaccatcctcgtcggcctcacgcctgaggatgaggctgtattattactgttgctnatntgcgtacggtcgtacgtcgttgggtcgtcggacggacggacgaacgtcgtacgtaccgtacgtacggtcacgccg

SEQ ID NO: 443238 - DNA, 509 bp, Homo sapiens
  misc_feature: GZ8MTXP02G51MO.10.59.F04.1.454.CMB.2.raw
  modified_base (225)..(225): a, c, t, g, unknown or other
  modified_base (264)..(264): a, c, t, g, unknown or other
  modified_base (399)..(399): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccggtctcctgggcagtcagtcaccatctctgcactggaaccngcagtgatgttggtgtatgacttgtctcctggtaccaanagcagccaggcgaacgcccccaaatcatgatttatgatgtcagtgcgcgccccgtcggggtccctgactcgcttctcgtcggctccaagtctgcaaccacgccctccctgaccatctctcgcctcagcctgacgntgagtctagtattattacgtgttcgctctatatgcgacggtcgtacgtcgttgggtcgtcggacgtacgggaaccaaggctacggacccgtcgtaacggtccacgacccg

SEQ ID NO: 443239 - DNA, 539 bp, Homo sapiens
  misc_feature: GZ8MTXP02G8Y6B.10.59.F04.1.454.CMB.2.raw
  modified_base (231)..(231): a, c, t, g, unknown or other
  modified_base (307)..(307): a, c, t, g, unknown or other
  modified_base (408)..(408): a, c, t, g, unknown or other
  modified_base (436)..(436): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtcccgggtctccgtgggcagtcagtcaccatcctcctgcacgtggaaccngcagtgatgttggtgttatgactttgtctcctgtaccaacagcagccaggccgaacgcccccaaatcatgtattangatgtcagtgccgcggcccccgtcggggtccctgactcgcttctcgtgctccgagtctggcaacgcgcctccctgaccatctcgcgcctcagcctgaacgntgacggtctggtatttatcgttggtacnctcatagtgacgtacggtaccggtccgtcggtttggggtcggttcggggacggtaacgggacaaggtccgtacggtaccgtccgtaacggcgacggaccccgg

SEQ ID NO: 443240 - DNA, 526 bp, Homo sapiens
  misc_feature: GZ8MTXP02GR6MM.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtgtatgacttgtctctggtaccaacagcagccaggcgaacgccccaaatcatgatttatgatgtcagtgcgcggcccccgtcggggtcctgactcgcttctcgtgctcagtctggcaacacgccctccctcgaccagtcctcgtcggccctcacgcctggagagtgaggtctagtattatacgtgttcgctcatatcgcgtacggtcgtaccgtcgttggggttcgttcggggacggtaacgggaccaaggtcgtacggtacccgtccgtacggccacgaccccgg

SEQ ID NO: 443241 - DNA, 512 bp, Homo sapiens
  misc_feature: GZ8MTXP02FSH6F.10.59.F04.1.454.CMB.2.raw
  modified_base (225)..(225): a, c, t, g, unknown or other
  modified_base (299)..(299): a, c, t, g, unknown or other
  modified_base (329)..(329): a, c, t, g, unknown or other
  modified_base (355)..(355): a, c, t, g, unknown or other
  modified_base (368)..(368): a, c, t, g, unknown or other
  modified_base (373)..(373): a, c, t, g, unknown or other
  modified_base (380)..(381): a, c, t, g, unknown or other
  modified_base (388)..(388): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctctgcactgaaccngcagtgatgtggtgttatgacttgtctctggtaccaacagcagccaggcgaacgcccccaaattcatgtattangatgtcagtgcgcggccccgtcggggtccngctcgcttctctgctcagtctgcacncgcctccctgacntctcncgcctcnncctgagntggagctagtattattagtcgtctgtctacattacgcggacgacgggccggtaccgttcgggttaccggtattcggtcgttacggaacgtcgggacctaccgggtcaccggtcctacggtaccg

SEQ ID NO: 443242 - DNA, 518 bp, Homo sapiens
  misc_feature: GZ8MTXP02HI8F6.10.59.F04.1.454.CMB.2.raw
  modified_base (395)..(395): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtgtatgacttgtctcctgtaccaacagcagccaggcgaacgccccaaattcatgtattatgatgtcagtgcgcggccccgtcggggtcctgactcgcttctctgctcgagtctggcacgcgcctccctgaccatctcgtcgcctcagcctgacgntgagtctagtattatactgttcgctacattagtcgcgtacggtccggttaccgtcggttggggtcgttcgggacgggtacggaccaaggtcgtacggacccggtcgtacggtccgacgacccg

SEQ ID NO: 443243 - DNA, 511 bp, Homo sapiens
  misc_feature: GZ8MTXP02IPIP1.10.59.F04.1.454.CMB.2.raw
  modified_base (226)..(226): a, c, t, g, unknown or other
  modified_base (298)..(298): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcacatctcctgcactggaaccngcagtgatgtgtggtatgacttgtctcctggtaccaacagcagccaggcgaacgccccaaattcatgattangatgtcagtgcgcggccccgtcggggtcctgactcgcttctctgctccagtctggctaacacgcctccctgaccatctctcggccctcacgcctgaggactgacggctggtattattactgttgctcatatgacgtacggccggtaccgtcgttggggtcgttcgggcgggacgggactaaggctacgaccgtcgtacggtcacgaaccccgg

SEQ ID NO: 443244 - DNA, 520 bp, Homo sapiens
  misc_feature: GZ8MTXP02IYFP5.10.59.F04.1.454.CMB.2.raw
tcagcatagtagtgcacgaccggtgctcgatttagtacacacacttagggattggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggcccccgtcggggtcccctgactcgcttctctggctccagtctggcacacgcctccctgaccatctctcggcctccagcctgagatgaggctgattattactgttgctcatatgcaggcgtaccgcgttgggtcgtttacgggcggacgggtacccgaaaggccgtacggaacccggtccgtaacggttccgacgaaccccgg

SEQ ID NO: 443245 - DNA, 625 bp, Homo sapiens
  misc_feature: GZ8MTXP02IVLTF.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggatcagtctgccctgactcagcctcgctcagtgtccgggtctcctgggcagtcagtcaccatctcctgcactggaaccngcagtgattgttggtggttatgacttgtctcctggtaccaacagcagccaggcgaacgcccccaaatcatgattatgatgtcagtgcgcggccccgtcggggtcctgactcgcttctcgtcgctaccgagtctcggctaacgaccggtcctccctgacccattcctctcggccctccgacgtccgtagacggagtcggacgggtcttaggtaactttaacgtttaccgttgtttacggcttaccgtaattaagtcggaccggtacggggtacccgggttaaccgggttcggtttacgggggttcggtttccgggggaccggggttaacgggggaacccgaaaggtcccggtacggtaccccggttaccgtaacgggttaccgtaaccggtacccccgg

SEQ ID NO: 443246 - DNA, 589 bp, Homo sapiens
  misc_feature: GZ8MTXP02G6TWU.10.59.F04.1.454.CMB.2.raw
  modified_base (227)..(227): a, c, t, g, unknown or other
  modified_base (298)..(298): a, c, t, g, unknown or other
  modified_base (380)..(380): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggcagtcagtcaccatctcctgcactggaaccngcagtgatgttggtgttatgacttgtctctgtaccaacagcagccagcgaacgccccaaatcatgtattangatgtcagtgcgcgccccgtcggggtcctgactcgtcttcgtctcgctccgaagtctggaccaacgaccgccctcctgaccntcctcgtcggccctcacgcctagaggtactggacggtctaggtaactttattacgtggttcgacttactaagtacgtgaccgtacgggtacccggttacccggtcgtttcgggggttcggttccggggtaccgggtaacggggtaaccctaaacggtccgttaccgggtacccgttacccgttaacggggtcccaaacggtacccccgg

SEQ ID NO: 443247 - DNA, 563 bp, Homo sapiens
  misc_feature: GZ8MTXP02ICVF0.10.59.F04.1.454.CMB.2.raw
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtggtggttatgacttgtctcctggtaccaacagcagccaggcgaacgcccccaaattcatgatttatgatgtcagtgcgcggccccgtcggggtccctgactcgtcttctcgtcgctaccgtagtctggaccaacgacccggtccctccctcgacctacttcctcgtcggccctccgacgcccgtggaggatggacggtctagtatttaacttacgttgttcgctactatagtgacgtacgggtcggtaccgtcggttggggtcggttcgggacgggtacggaccgaacggtcgtacggtaccgtaccgtacggtaccgacgacccg

SEQ ID NO: 443248 - DNA, 553 bp, Homo sapiens
  misc_feature: GZ8MTXP02IP6H1.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtgttatgcttgtctctgtacacagcagccaggcacgcccccaaattcatgatttatgtatgtcagtgcgcggccccgtccggggtcctgactcgtcttctcgtcgctccgagtctggacacaccgcctcccgtgaccatcctctccggccctccgagccctggacggtattcggaggtcttggtactttacttacgttgttcgcttacattagtgaccgtaaggtccggttaccgtcgtttggggtcgttccggggacggtacgggaacgtaacgtcgtacggtacccgtcgtacggtccgtacggaaccccg

SEQ ID NO: 443249 - DNA, 582 bp, Homo sapiens
  misc_feature: GZ8MTXP02I9AOY.10.59.F04.1.454.CMB.2.raw
  modified_base (227)..(227): a, c, t, g, unknown or other
  modified_base (268)..(268): a, c, t, g, unknown or other
  modified_base (304)..(304): a, c, t, g, unknown or other
  modified_base (384)..(384): a, c, t, g, unknown or other
  modified_base (415)..(415): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccaggtctcctgggcagtcagtcaccatctcctgcactggaaccngcagtgatgttggtgttatgacttgtctcctggtaccaacngcagccaggcgaacgcccccaaattcatgtatttangatgtcagtgcgccggcccgtcggggtcctgactcgcttcgtctggctccagtctggacaacgacggccctcctcgaccngtctcctcggccctccagccctaggacggtntcggagggtcctaggtaactttacgttaccgtggtttcgacttactaattacgtcgtacgtacgggtccgggttaccgtcggtttggggtcggtttaccggggacgggaacggggtaacccgaaggtccgtacgggtaaccccgttcggtacgggtaccgaacccgg

SEQ ID NO: 443250 - DNA, 660 bp, Homo sapiens
  misc_feature: GZ8MTXP02G48IK.10.59.F04.1.454.CMB.2.raw
  modified_base (211)..(211): a, c, t, g, unknown or other
  modified_base (229)..(229): a, c, t, g, unknown or other
  modified_base (269)..(269): a, c, t, g, unknown or other
  modified_base (303)..(303): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgggcagtcagtcaccntctcctgcactggaaccngcagtgatgttggtgttatgtacttgtctctggtaccaangcagccgaggcaacgaccccaaatcatgtattangtatgtcagtgcgccggccccggtccggggtcctgactcgtcttcgtcgtcggctccgaagtcgtcggaccaacgacccgtccctcccgtcgaccctactcccgttccgtccggtccctacccgacgtcccgtagggtaacggtagtacgggacggtccgttaagttaacgttttaacgtttaaccgttggtttcggtaccgttacctaagttaacggtcggaccggtaacggggttcccgggttaaccgggttcgggttttcgggggtacgggtttccgggggaccgggggtaaccggtaaccgaacggtccggtaccggttacccgtacggtaccggaccgacccggtaacccgg

SEQ ID NO: 443251 - DNA, 709 bp, Homo sapiens
  misc_feature: GZ8MTXP02G3BQT.10.59.F04.1.454.CMB.2.raw
  modified_base (228)..(228): a, c, t, g, unknown or other
  modified_base (309)..(309): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctctgcactggaaccngcagtgatgttggtggttatgtacttgtctcctggtaccaacagcagccaggcgaacgacccccaaattcatagtatttangtatgtcagtgccgcggcccccgtcggggtcctgactcgtcttctcgtcggctaccgaagtcgtacgggacctaaacccgaccggtccctacccctacgaaccctacttcccgttccgttccgggtcccccttacccgtaaccggtccccgttagggaaaccgggtacgttagggacgggttaccttagggtaaactttttaacgttaaccgtttggtttacggtacgttaccttaagttacgttcggaccggtaacggggtccgggttaacccggttcgggtttcgggggttacgggtttccgggggaccggggaaacggggtaacccgtaaacgggtcccgttaaccggggtaccccggttaccggttaaccgggtaccgtaaccggtaacccccggg

SEQ ID NO: 443252 - DNA, 604 bp, Homo sapiens
  misc_feature: GZ8MTXP02I3JBX.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagccctcgctcagtgtccgggtctcctgggcagtcagtcaccatctctgcactggaaccngcagtgatgtggtgttatgtacttgtctctggtaccaacagcagccaggcgaacgcccccaaattcatgtattatgatgtcagtgcgcggccccgtcggggtccctgctcgtcttcgtcgtcgtctaccgtagtcgtcggaccaaccgacccggtccctcccgtcgaaccctacttcccgtcgttccggcccttcccgacgtcccgtagacggattggacggtctacggtattttacttaccgttgttcgtactactagtagtcggtaccgacgggtccggttaaccggtcgggtttgggggtcggtttcggggacgggtacgggaaccgtaaggccggtacgtacccggtccgtaacggtccgaacggtaccccgg

SEQ ID NO: 443253 - DNA, 596 bp, Homo sapiens
  misc_feature: GZ8MTXP02G2V8H.10.59.F04.1.454.CMB.2.raw
  modified_base (229)..(229): a, c, t, g, unknown or other
  modified_base (314)..(314): a, c, t, g, unknown or other
  modified_base (467)..(467): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtgatgttggtgcttatgtactttgtcctccgtggtaccaacagcagccaggaccgaacgacccccaaattcatgtatttangatgtcagtgcgcccggcccgtcggggtcctgactcgtcttctctcggcctccagtcgtcggaccaaacgccggtccctccctagaccctatcctcgtcggccctacgacgccgtaggacgtagtggagtctagtaacttagttactggttcnccttatagtacgtcggacgtacgggtccggtaccgttcgggttcgggggttcgttaccggggacggggtaacggggtaaccacggtccggttacggacccggttacccggtaacgggtaccaacccggg

SEQ ID NO: 443254 - DNA, 565 bp, Homo sapiens
  misc_feature: GZ8MTXP02GR7KO.10.59.F04.1.454.CMB.2.raw
  modified_base (225)..(225): a, c, t, g, unknown or other
  modified_base (264)..(264): a, c, t, g, unknown or other
  modified_base (297)..(297): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggcagtcagtcacatctctgcactggaaccngcagtgatgttggtgttatgtacttgtctctggtaccanagcagccaggcgacgccccaattcatgatttangatgtcagtgccggcggcccccgtcggggtccctgactccgtcttcgtcgtcgcctccgaagtcctggaccaaccgaccggtccctcccgtcgaccctatcccgttccgtccggcccttccgacggtcccttaggacggtagtaggacgggtctacggttagtttacttaccgttgttacgtctactagtagtcgcgtacggtcgtacgtcggttggtcgtcggcggtaggactaaggtcgtacggaccgtcgacgtcgacgacccgg

SEQ ID NO: 443255 - DNA, 520 bp, Homo sapiens
  misc_feature: GZ8MTXP02HF5MM.10.59.F04.1.454.CMB.2.raw
  modified_base (210)..(210): a, c, t, g, unknown or other
  modified_base (228)..(228): a, c, t, g, unknown or other
  modified_base (301)..(301): a, c, t, g, unknown or other
  modified_base (402)..(402): a, c, t, g, unknown or other
  modified_base (424)..(424): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccntctcctgcactggaaccngcagtgatgttgtggttatgactttgtctctggtaccaacagcagccaggcgaagccccaaatcatgatttangatgtcagtgcgcgccccgtcggggtcctgatcgcttctcgtcgctccagtctggcaacgacgccctccctgacctactctctcggcctccagcctgacgntgagtctgtattattactgttnctacattatgacgtacggtccggtacgtcggttgggtcggttcggggcggacgggtaccaaggcgttacgaccgtccgttacggctacggaccccg

SEQ ID NO: 443256 - DNA, 528 bp, Homo sapiens
  misc_feature: GZ8MTXP02IOKQN.10.59.F04.1.454.CMB.2.raw
  modified_base (208)..(208): a, c, t, g, unknown or other
  modified_base (224)..(224): a, c, t, g, unknown or other
  modified_base (258)..(258): a, c, t, g, unknown or other
tcagcatagtagtgcacgaccggtgctcgatttagtacacacacttagggattgggggggtctcaggaggcagtactctcgggacgtctccaccatggcctgggctctgctcctcctcagccctcctcactcagggcacaggatcctggctcagtctgccctgactcagcctcgctcagtgtccggtctccgtgggcagtcagtcacntctctgcactggaccngcagtgatgtgtgtatgacttgctctgtaccaanagcagccaggcgaacgccccaaattcatcgatttatgatgtcagtgcgcggccgtccggggtccctgactcgcttcgtctcggcctcgaagtctcggacaacgacggcccttccgacgaccatcctcgtcgcccttcgacgtctcgagctagaggtctgtaacttagtacctgtcgtacctatacgtgccgtaaggccggttacgcgttcggtcgtcggtcggacggacgacgcgtcgtaccgtcgtacgtcgtacgaccgacggtcccg

SEQ ID NO: 443257 - DNA, 561 bp, Homo sapiens
  misc_feature: GZ8MTXP02IV4XY.10.59.F04.1.454.CMB.2.raw
  modified_base (227)..(227): a, c, t, g, unknown or other
  modified_base (233)..(233): a, c, t, g, unknown or other
  modified_base (303)..(303): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagccctcctcactcagggcacaggatcctgggctcagtctgccctgactcagcctcgctcagtgtccggtctccgtgggcagtcagtcaccatctctgcactggaaccngcagtnatgttgtggtatgacttgtctcctggtaccaacagcagccaggcgaacgccccaaatcatgattatgatntcagtgcgcggccccgtcggggtcctgactcgccttctctggctccgagtcgtgacaaccaccgcctccctgaccatcctctcggcctccgagccctaggaggtactggacggtctaggtacttacgttacgtcgttcggacttactacttagtcgacgtaacgggtccggttaccggtcggttggggttcggttccggggacgggtacgggaccgaaggtccgtacggtacccggtcgtacggtccgacgaccccgg

SEQ ID NO: 443258 - DNA, 518 bp, Homo sapiens
  misc_feature: GZ8MTXP02F0A5E.10.59.F04.1.454.CMB.2.raw
  modified_base (305)..(305): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtggtggttatgactttgtctcctggtaccaacagcagccaggcgaagcccccaaattccatgatttangatgtcagtgcgcggcccccgtcggggtccctgactcgcttctcgtcggctccaagtctggcacacgcctccctgaccatctctcggcctccgagcctgacggatgaggctgtattattacgtgttcgctcatatgcaggcggtacgtcgttgggtcggttcggacgggtacggaccaaggcgtacggtacccgtcgtacggtcacgacccgg

SEQ ID NO: 443259 - DNA, 568 bp, Homo sapiens
  misc_feature: GZ8MTXP02I1AQE.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactgaaccngcagtgatgttggtgttatgactttgtctcctggtaccaacagcagccaggcgaacgcccccaaatcatgatttatgatgtcagtgcgcgccccgtcggggtcctgatcgcttctcgtgctcgagtctcgcaacgacgcctccctgaccatcctcgtcgcctcgacgcctgacggtatggagtctgatttatacttgttcgctctagtagtcgcgtaacgggtccggttaaccggtcggtttcgggggtcggtttccggggacgggttaacggggaaccccgaaggtcccgttcgggtaaacccggttcccgttaaacggggtccaaccggtaacccccgg

SEQ ID NO: 443260 - DNA, 515 bp, Homo sapiens
  misc_feature: GZ8MTXP02FYI3O.10.59.F04.1.454.CMB.2.raw
  modified_base (229)..(229): a, c, t, g, unknown or other
  modified_base (308)..(308): a, c, t, g, unknown or other
  modified_base (368)..(368): a, c, t, g, unknown or other
  modified_base (377)..(377): a, c, t, g, unknown or other
  modified_base (387)..(387): a, c, t, g, unknown or other
  modified_base (404)..(404): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtgattgttggtggttatgtactttgtctcctggtaccaacagcagccaggcgaagcccccaaattcatgatttangatgtcagtgcgcggcccccgtcggggtccctgatcgcttctctggctcagtctgcaacncgcctcccngaccatctcncgcctccagcctgaggntggagctgtatttattacgtgttcgctcatagtgcacgggtcggtacgtcgttggggtcgttcgggacggacgggacaaggcgtacggaccgtcgtacggtcacgacccgg

SEQ ID NO: 443261 - DNA, 572 bp, Homo sapiens
  misc_feature: GZ8MTXP02GDKHL.10.59.F04.1.454.CMB.2.raw
  modified_base (306)..(306): a, c, t, g, unknown or other
  modified_base (349)..(349): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaacgcccccaaattcatgtatttangatgtcagtgcgcggcccccgtcggggtccctgactcgcttcnctcggctccagtctgcaacgccgcctccctgaccatcctcctcggccctccgacgccgtgacggatggacggtctggtatttacgttacgtgttacgcttacatagtcgacgtacgggtccggttaccgtcggtttaggggtcgggtttccggggacggggtacgggacccgtaaggtcccgtacggtacccggttaccgtacggtccgaccggtaaccccgg

SEQ ID NO: 443262 - DNA, 693 bp, Homo sapiens
  misc_feature: GZ8MTXP02HQ096.10.59.F04.1.454.CMB.2.raw
  modified_base (229)..(229): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtgattgttggtgtatgtacttgtctcctggtaccaacagcagccaggcgaacgcccccaaattccatgattatgatgtcagtgcgcggcccccgtcggggtcctgactcgtcttctcgtcggctccgaagtccgtcgggaccaaaccgaccggtccctacccgtcgaccctattccctcgtccggccctacccgcgtcccgtaggacggtagttacggacggtacgttacggttaagttttaactttaccgtttgggttcgtaccctttactaaacgtttaagtcggacggtaaccggggtcccggggtttaacccccgggttcggtttgggggtttaccgggtttccgggggacccggggtaacgggggttaacccgaaaaccggggtccgtttaacccggggtacccccgggttaccgtttaaccggggtacccggtaaacccggggtaccccccggg

SEQ ID NO: 443263 - DNA, 507 bp, Homo sapiens
  misc_feature: GZ8MTXP02FXXY8.10.59.F04.1.454.CMB.2.raw
  modified_base (227)..(227): a, c, t, g, unknown or other
  modified_base (301)..(301): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgtggtgttatgactttgtctctggtaccaacagcagccaggcaacgcccccaaattcatgatttangatgtcagtgcgcggcccccgtcggggtccctgatcgcttctctggctcaagtctggcaacacgcctccctgaccatctctcggcctccagcctgacggatgaggctagtacttattactgttgcttcatatgcaggcgtaccgcgttggggtcgttcgggcggacggtaccaagccgtacggaccgtccgtacggtcacgacccg

SEQ ID NO: 443264 - DNA, 644 bp, Homo sapiens
  misc_feature: GZ8MTXP02HB1AE.10.59.F04.1.454.CMB.2.raw
  modified_base (307)..(307): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcatcctcgctcagtgtccgggtctccgtgggcagtcagtcaccatctcctgcactggaaccagcagtgatgttggtggttatgtactttgtctccgtggtaccaacagcagccaggcgaacgcccccaaatcatgatttangtatgtacagtgcgcggcccccgtcggggtcctgactcgtcttctcgtcggtcctaccgtagtccgtcgggacccaaaccgcccggtccctcccgtacgaccctacgttccctcgtcggtcccctccgacgtcccgtaggacggtactaggcggtcctaggttatttaacgttcgttcggttcgtacttacgtattagtcgaccggtaacggggtcccggttaccggtccgggtttgggggttccggttaccgggggtaccgggaacgggtacccgaaagggtcccgttaacgggtaccccggttaccgtacgggttacccgaaccggtaaccccgg

SEQ ID NO: 443265 - DNA, 550 bp, Homo sapiens
  misc_feature: GZ8MTXP02F4Y26.10.59.F04.1.454.CMB.2.raw
  modified_base (271)..(271): a, c, t, g, unknown or other
  modified_base (456)..(456): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccagcagtgatgttggtggttatgactttgtctcctggtaccaacngcagccgaggcgaacgcccccaaaattccatgactttatgatgtcagtgcgcggccccgtcggggtccctgactcgcttctcgtcggctaccgagtctggaccaacgacgccctccctcgacctatcctctcggcctccagcctgacggatgacggctagtatttacttacgtgttcgctcaatntcgcgtacgggcggtaccgtcgttcgggttggttccgggacgggtcgggacccgaaggtccgtacgtacccgtcgtaacggtcacggtaacccg

SEQ ID NO: 443266 - DNA, 620 bp, Homo sapiens
  misc_feature: GZ8MTXP02GLMGX.10.59.F04.1.454.CMB.2.raw
  modified_base (227)..(227): a, c, t, g, unknown or other
  modified_base (265)..(265): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgattgttggtgttatgtcttgtctcgtgtacanagcacgcgaggacgaccgaccccaatcatgtattatgtatgtacagtcgccggccggtccccgtccggggtcctgactcgtcttcgtcgtcgctaccgtacgtcgtcgaccaacgccgtccctcccgtacgacctactccgtcgtccggtccctccgacgtccgtagacggtacgtacggacggtcttagttaatttacgttacgttcgttcgtacgttactagttacgtcggaccggtacgggtcccggttaccggtcgggtttcggggttcgggttccggggtaccggggtacgggtaccggtaacgtccggtaccggtacccggttaccggtacggtaccgaccggtacccg

SEQ ID NO: 443267 - DNA, 579 bp, Homo sapiens
  misc_feature: GZ8MTXP02HORKH.10.59.F04.1.454.CMB.2.raw
  modified_base (237)..(237): a, c, t, g, unknown or other
  modified_base (430)..(430): a, c, t, g, unknown or other
  modified_base (461)..(461): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggcggccccagatgggtcctgtcccagctgcagctgcatgagtcgggcccaggactggtgaggccttcggataccctgtccctcagttgcgctgtctctggtgctcatcaacngtgtgacaacgtggtgggctgggtccgccgacgcccccgagggagtgggacgtggagtggattggccttacactattatagtggactacccactaccaacccgtcctcaggagtcgagtcaccatctacactagaccacgtccaagaactccacctcctccctgacgtcgacctctgtcgaccgccgcggacncggctgttattattgtgcgagacgaccccgngtagaacgtacttacctactaaacgttgtacctttacgaacccgtacggtacgggggacccgaaggggtaaccgtccccgtacggtacccaccggtttcctcccgttacgtaaccccg

SEQ ID NO: 443268 - DNA, 537 bp, Homo sapiens
  misc_feature: GZ8MTXP02F4AQZ.10.59.F04.1.454.CMB.2.raw
  modified_base (228)..(228): a, c, t, g, unknown or other
  modified_base (266)..(266): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctctgcactggaaccngcagtgatgttggtgttatgacttgctctggtaccaanagcagcaggcgaacgacccccaaatcatgtattatgatgtcagtgcgccggccccgtcggggtcctgactcgcttctcgtgctcagtctggacaacgaccgtcctacctcgaccattctcgtcgtcctacctacgcctagacggatggagtctagtaattattacgttgtcgtactacatatgacgacggtcgtaccgtcggttgggtcgttccgggacgggtacggaacctaagtccgtacgtacccggtacgtacggtaccacgacccg

SEQ ID NO: 443269 - DNA, 647 bp, Homo sapiens
  misc_feature: GZ8MTXP02HRFPR.10.59.F04.1.454.CMB.2.raw
  modified_base (231)..(231): a, c, t, g, unknown or other
  modified_base (274)..(274): a, c, t, g, unknown or other
  modified_base (307)..(307): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagccctcgctcagtgtccgggtctccgtgggcagtcagtcaccatcctcctgcactggaaccngcagtgatgttggtggttatgtacttgtctcctggtaccaacngcagccaggcgaacgccccaaatcatgatttangtatgtacagtcgcggccggtcccccgtcggggtccctgactcgcctttctcgtcggctccgaacgttctcggacaaaccgccgtccctacccgtacgaccctacgtccgtccgtccggtcccttacccgacggtacccgttagggacgggtacttcgggaacgggtcttaggttaactttaacgtttccgtggtttccgcttctaaagttagtcggacgtaacgggtccggtttaccggtccggtttgggggttccggttcgggggccggggtaaacgggacccgtaaagggccttacggtacccggttaccgtacggggttaccaaccggtacccccg

SEQ ID NO: 443270 - DNA, 590 bp, Homo sapiens
  misc_feature: GZ8MTXP02FHTAD.10.59.F04.1.454.CMB.2.raw
  modified_base (228)..(228): a, c, t, g, unknown or other
  modified_base (303)..(303): a, c, t, g, unknown or other
  modified_base (333)..(333): a, c, t, g, unknown or other
  modified_base (345)..(345): a, c, t, g, unknown or other
  modified_base (361)..(361): a, c, t, g, unknown or other
  modified_base (373)..(373): a, c, t, g, unknown or other
  modified_base (384)..(384): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtatgccctgactcagcctcgctcagtgtccgggtctcctgggcagtcagtcaccatctcctgcactggaaccngcagtgattgtggtgttatgactttgctcctggtaccaacagcagcaggcaacgcccccaaattcatgtatttangatgtcagtgcgcggccccgtcggggtccngatcgcttctcnggctcagtctgcaacnccgccctcccgngaccatcctcncggccctccgagcccgtgaggagtggacggtctagtaactttattaccttggttcgcttaccaatagtcgaccgtaacgggtccgggttacccgtcggtttcgggggttacggtttccgggggaaccggggaacgggtaaacccgaaacgggtccgttaccggaaaccccggttcccgttaacgggacccgaacggtaacccccgg

SEQ ID NO: 443271 - DNA, 668 bp, Homo sapiens
  misc_feature: GZ8MTXP02G0EY7.10.59.F04.1.454.CMB.2.raw
  modified_base (212)..(212): a, c, t, g, unknown or other
  modified_base (230)..(230): a, c, t, g, unknown or other
  modified_base (302)..(302): a, c, t, g, unknown or other
  modified_base (336)..(336): a, c, t, g, unknown or other
  modified_base (404)..(404): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgggcagtcagtcaccntctcctgcactggaaccngcagtgatgtggtgtatgacttgctctggtaccaacagcagcaggacgaacgaccccaaatcatgtatttangtatgtcagtgcggcggcccccgtcggggtcccngactcgcttctcgtcggcttccaagtctacggccaaacgaccggccctcccgtgacctactcgttccncggtccctaccgcgcccgttaggacgtagtacggtaacgggtcttagtaaaggttttactttaaaccgttggtttcggtacccgttataaacgtttaagtcggaccggtaaaacgggggtcccgggttaaccgggtccggtttaggggggtttcgggtttacccgggggtacgggggtaaaccgggtaaaccgtaaacggcccggtttaaccgggaaccccggttaccggtttaacgggtaccccgaacggtaaaccccccggg

SEQ ID NO: 443272 - DNA, 588 bp, Homo sapiens
  misc_feature: GZ8MTXP02H4UF8.10.59.F04.1.454.CMB.2.raw
  modified_base (229)..(229): a, c, t, g, unknown or other
  modified_base (269)..(269): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatccgtgggctcagtctgccctgactcagcctcgctcagtcgtccggtctccgtgggcagtcagtcaccagtctctgcactggaaccngcagtgatgttggtgttatgtacttgtctctggtaccaanagcagccaggccgaacgccccctaaattcatagtatttatgatgtcagtgcgcggccccgtcggggtccctgactcgtcttcctcgtcggtctaccgtagtcctcggacctaacccgaccgccctccctcgacctacgtccttccgtccggccctcccgacgccctggacggtattcggacggtcttaggtatttacttacgttgtcgtctactagtagtcgacgacgggtccgtacggtcggtttgggtacggttcgggacgggtacgggaccgtaagtccgtacggtacccggtaccgtacggtccgacgaacccgg

SEQ ID NO: 443273 - DNA, 512 bp, Homo sapiens
  misc_feature: GZ8MTXP02FTET8.10.59.F04.1.454.CMB.2.raw
  modified_base (229)..(229): a, c, t, g, unknown or other
  modified_base (338)..(338): a, c, t, g, unknown or other
  modified_base (350)..(350): a, c, t, g, unknown or other
  modified_base (366)..(366): a, c, t, g, unknown or other
  modified_base (376)..(376): a, c, t, g, unknown or other
  modified_base (425)..(425): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtgattgttggtggttatgactttgtctcctggtaccaacagcagccaggccgaagcccccaaatcatgatttatgatgtcagtgcgcggccccgtcggggtcccngatcgcttctcngctcagtctggcaacncgccctcccncgaccactctcgcggcctccagcctgagatgaggctgattatactgttnctgatagtgcacggtcgtaccgtcgttgggtcgttcggcggagggaccaaggtcgtcggacccgtcgtacggtaccgacgtacccgg

SEQ ID NO: 443274 - DNA, 507 bp, Homo sapiens
  misc_feature: GZ8MTXP02HDLMC.10.59.F04.1.454.CMB.2.raw
  modified_base (230)..(230): a, c, t, g, unknown or other
  modified_base (381)..(381): a, c, t, g, unknown or other
  modified_base (423)..(423): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgcccctgactcagcctcgctcagtgtccgggtctcctgggcaggtcagtcaccatctcctgcactggaaccngcagtgatgtggtgttatgactttgtctcctggtaccaacagcagccaggcgaacgcccccaaattcatgatttatgatgtcagtgcgcggccccgtcggggtcctgatcgcttctctggctccagtctgcaacgacgccctccctgaccntctctcgcctcagcctgaggatgagctagacttatactgttnctcatatgcgacggcggtcgtcgttggggtcgttcgggacggaacggaccaaggcgtacgacccgtcgtacggtccacgacccg

SEQ ID NO: 443275 - DNA, 680 bp, Homo sapiens
  misc_feature: GZ8MTXP02F5772.10.59.F04.1.454.CMB.2.raw
  modified_base (227)..(227): a, c, t, g, unknown or other
  modified_base (304)..(304): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgtggtggttatgactttgtctcctggtaccaacagcagccaggcaacgcccccaaaattcatgatttangatgtcagtgcgcggccccgtcggggtccctgactcgcttctcgtcgctccgaagttcctcgggaccaaccgaccggtccctccccgtacgaccctacttcccttccgtccggtccccttacccgacggtcccctagggaacgggtactacgggtaacgggtccttaggtaacttttacgtttaaccgttgtttcggtacttactaattaacgtttcggaccgtaacgggggttcccggttaaccgggtccggttttgggggttccgggtttccgggggaccggggtaaccgggggaaccccgaaaaggggttccccggtcggttaaaacccccgggttccggttaacgggttacccggtaacggtaacccccggg

SEQ ID NO: 443276 - DNA, 496 bp, Homo sapiens
  misc_feature: GZ8MTXP02JF089.10.59.F04.1.454.CMB.2.raw
  modified_base (227)..(227): a, c, t, g, unknown or other
  modified_base (398)..(398): a, c, t, g, unknown or other
  modified_base (418)..(418): a, c, t, g, unknown or other
  modified_base (421)..(421): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgtgtgtatgacttgtctctgtaccaacagcagccaggcgaacgccccaaattcatgattatgatgtcagtgcgcggccccgtcggggtccctgactcgcttctcgtcgctccaagtctggacaacacgtccctcctgaccatctctcgccctcagcctgaggntgaggctgattatactgttnctnatatgacgcggcgtaccgcgttgggtcgttcggacggaggaccaagcctacgtaccgtccgaggtccacgacccg

SEQ ID NO: 443277 - DNA, 623 bp, Homo sapiens
  misc_feature: GZ8MTXP02FSKT4.10.59.F04.1.454.CMB.2.raw
  modified_base (227)..(227): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgtggtgttatgattgtctctggtaccaacagcagccaggcgaacgcccccaaattcatgtatttatgatgtctagtgcgtccggcccccgtccggggtccctgactcgtcttctcgtggctccgaagtctacggcaacaccgcctccctcgaccacgtcctctcggccctccgacgtcctagaggacgtgacgggtcttaggtaacttttagtaaccttgggtttcacgtttaccgtagttaactcggtaccggtaacgggtcccgggttaaccggttcggtttacgggggttcggtttaccgggggtaccgggaacgggggtaaacccgtaaacggtccggttaccggtacccggttaccggtttacggaccgtaccggaaccccgg

SEQ ID NO: 443278 - DNA, 636 bp, Homo sapiens
  misc_feature: GZ8MTXP02HQCAT.10.59.F04.1.454.CMB.2.raw
  modified_base (210)..(210): a, c, t, g, unknown or other
  modified_base (228)..(228): a, c, t, g, unknown or other
  modified_base (304)..(304): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagccctcctcactcagggcacaggatcctgggctcagtctgccctgactcagcctgctcagtgtccgggtctccgtgggcagtcagtcaccntctcctgcactggaaccngcagtgatgttggtgtatgacttgtctctggtaccaacagcagccaggccgaacgcccccaaattccatgatttangtatgtcagtgcgccggcccccgtcggggtcccctgactcgtccttcgtcgtcggcctaccgaagttccgtcggaccaaacccgacccgtccctccccgtcgacccacttccctccgtccggtccccttaccgacgtcccgtaggaacggtacgtggaacggtctagtaacgtttactttaccgttgttcgtaccttcgtaaattgtcgaccgacggtccgggtttaccgtccggtttgggggttaccgttccggggaccggggtaacgggacccgaaacgggtcgttaccggaacccggttccgtaacggggtacctaacggaacccccgg

SEQ ID NO: 443279 - DNA, 581 bp, Homo sapiens
  misc_feature: GZ8MTXP02IEC7K.10.59.F04.1.454.CMB.2.raw
  modified_base (228)..(228): a, c, t, g, unknown or other
  modified_base (406)..(406): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcaggcacaggatcctgggctcagtctgccctgactcagccctgctcagtgtccggtctcgtggcagtcagtccaccatcctcctgcacgtcggaaccnggcagtgatgtggtgttatgtactttgctccgtcggtaccaagacgcacgaccgaggaccgaaccgaccccctaaagtcagtgtacttatgatgtacagtcgcgccggccccgtcggggacctgactcgtcttcgtctcggctacgagtcgtcgacaaccgtccgccctcctcgaccngtccctcgccgtacctcgacgccgaggacggtatcggacgtgtacggttatttaacttcgttagtcgcttcgaagttcgtgaccgtaacggggtccgttcggttccggttggggttcgggtaccggacggggacccgagaacgtcgtaaccgcgtacgtacgcgaaccggcccgg

SEQ ID NO: 443280 - DNA, 599 bp, Homo sapiens
  misc_feature: GZ8MTXP02IGKTV.10.59.F04.1.454.CMB.2.raw
  modified_base (272)..(272): a, c, t, g, unknown or other
  modified_base (307)..(307): a, c, t, g, unknown or other
  modified_base (315)..(315): a, c, t, g, unknown or other
  modified_base (408)..(408): a, c, t, g, unknown or other
  modified_base (469)..(469): a, c, t, g, unknown or other
  modified_base (479)..(479): a, c, t, g, unknown or other
  modified_base (490)..(490): a, c, t, g, unknown or other
tcagcatagtagtgcacgaccggtgctcgatttagtacacacacttagggattgggggggggtctcaggaggcaacactctcgggacgtctccaccatggcctgggctctgctcctcctcagcctcctcactcagggcacaggatcctgggctcagtctgccctgactcagcctcgctcagtcgtccggtctccgtgggcagtcacgtcaccatcctcctgcacgtcggaaccagcagtgatggttggtgtatgtacttgtctctgtacacngcacgccgagacaaccgaccctaatcatgtattantatgtacngtcgcgccggtccgtccggggtcctgctcgtcttctcgtcgcctacgtacgtcgtacgaccaaacgcccggtacccttacccgacgtaccctnttcccgtccgtcggaccctcgacgccgtaggagtatcggagtcgttaagttactttacgtntgtcaccgtntaacgttacgngaccggttcggtcggttaccggttcggttacggttcgggtccgggtaaacggacggtaaccgaacgtccgtacgacccgttcggtaaccgtacgacccgtacgacccgg

SEQ ID NO: 443281 - DNA, 493 bp, Homo sapiens
  misc_feature: GZ8MTXP02HJ14Z.10.59.F04.1.454.CMB.2.raw
  modified_base (303)..(303): a, c, t, g, unknown or other
  modified_base (345)..(345): a, c, t, g, unknown or other
  modified_base (384)..(384): a, c, t, g, unknown or other
  modified_base (423)..(423): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgacttgtctcctgtaccaacagcagccaggcgaagcccccaaattcatgatttangatgtcagtgcgcggcccccgtcgggggtcctgatcgcttcnctggctccaagtctggcaacacgcctaccctgaccatcnctcgcctcagctgagatgagctgattatacgtgttgctnatatgcgaggacgtccgtgttcgggtgttcgggcgtaggaccaagctacgaccgtcgacgtcacgacccg

SEQ ID NO: 443282 - DNA, 647 bp, Homo sapiens
  misc_feature: GZ8MTXP02GQE3Z.10.59.F04.1.454.CMB.2.raw
  modified_base (214)..(214): a, c, t, g, unknown or other
  modified_base (234)..(234): a, c, t, g, unknown or other
  modified_base (327)..(327): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatccgtgggctcagtctgccctgactcacgcctcgctcaggtcgtccggtctcgtgggcagtcagtcacctntcctctgcacgtcggaaccngcagtgtattggttggtggttatgtactttgtctccgtacgtaacacacgcacgccgaggaccaaacgacccccaaattcatacgtatttagngtatcgtagacgtcgccggtccggtcccccggtccggggtacctggtactccgtcttctcgtcgtactacgtagtccgaggaccaaccgtaccgtccttacccgacgacctactccgtacgtccggtacctccgacgccgtagtaaacggtgtcgtacgttacgttaggtaatttacgttaccgttggttactacgtaacttaagtacggttcgaccggttaacgggtccggttaacggttcggttcggggttcgggtaccggaacgggtacggaacgaacggtactacggtaccgtcgtaaccgtcggaccgtacccgg

SEQ ID NO: 443283 - DNA, 604 bp, Homo sapiens
  misc_feature: GZ8MTXP02G9UD9.10.59.F04.1.454.CMB.2.raw
  modified_base (227)..(227): a, c, t, g, unknown or other
  modified_base (307)..(307): a, c, t, g, unknown or other
  modified_base (394)..(394): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggcagtcagtcaccatctctgcactgaaccngcagtgatgtggtgtatgtacttgtctcctgtaccaacgagcagaccgaggaccgaacgaccccctaagtcatgtattangtatgcagtcgcgccggtccccgtcgggtcctgctctcttctgtacgtctccgtagtcgtacgcctaaaccgccgtccctacccgtnacccgtatccgtccgccggtacctcccgacgtccgtagggaccgtagtcggtacggtactcggttaactttacgttaacgttcggttactcgttaccagttagtcgtacgtacgggtcggttaccggtcggttcggggtacggttccgggacggaccggacgtaacgtccggttaccgtacccggtacgtacggaccgacgtaaccccgg

SEQ ID NO: 443284 - DNA, 596 bp, Homo sapiens
  misc_feature: GZ8MTXP02G15NE.10.59.F04.1.454.CMB.2.raw
  modified_base (230)..(230): a, c, t, g, unknown or other
  modified_base (301)..(301): a, c, t, g, unknown or other
  modified_base (307)..(307): a, c, t, g, unknown or other
  modified_base (366)..(366): a, c, t, g, unknown or other
  modified_base (388)..(388): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgggcagtcagtcaccatctcctgcactggaaccngcagtgatgttggtgttatgtactttgtctcctggtaccaacagcagccgaggcaacgcccccaaatcatntattangatgtcagtgcggccggccccgtcggggtcctgactcgtcttctctcggctccgagtcnggccaaacgccgtccctcccgngacccatcctcgtccggcccttccgacgtcccgtggaaacggtctacggacggtctacgttaagtttacttaccgttgtttcggtacccttagtaacgttagtcggtacgtaccgggtcccggttaccggtcggtttcggggtcggttccggggaccggtacggaccgaacgtcgtacgtacccgtcggtaacgtcgacggtaccccg

SEQ ID NO: 443285 - DNA, 626 bp, Homo sapiens
  misc_feature: GZ8MTXP02IX4Q1.10.59.F04.1.454.CMB.2.raw
  modified_base (483)..(483): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtgggcagtcagtcaccatctcctgcactggaaccagcagttgtagttggtggttgttatgttcttcgtcctcgtacgtaacacgcgacgacgaccgacggaaccgaaccccgaaccctaatactagttagtttaattagtagtagtcgtagtacgtccggaccggtccccggtccccggggtaccggtcctagtccgttcgttccttcgtcgtcgtacctaacgtacgtcgacgaccaccggtccctcccgtacacgaacctcgtccgtcgtccgaccaccgcgtacgnggaagtgaacggtcgtatacgtttaatttaccgtgttgtacgtacctaataccgtaggtcgaacgggtcggttaccgtggtcgggtttagcgggtaccggacggacgtacgtgtacgtccggtaactcgacgacgacccacgg

SEQ ID NO: 443286 - DNA, 493 bp, Homo sapiens
  misc_feature: GZ8MTXP02IP3FU.10.59.F04.1.454.CMB.2.raw
  modified_base (229)..(229): a, c, t, g, unknown or other
  modified_base (382)..(382): a, c, t, g, unknown or other
  modified_base (398)..(398): a, c, t, g, unknown or other
  modified_base (405)..(405): a, c, t, g, unknown or other
tcagcatagtagtgcacgaccggtgctcgatttagtacacacacttagggattgggggggtctcaggaggcagcactctcgggacgtctccaccatggcctgggctctgctcctcctcagccctcctcactcagggcacaggatcctgggctcagtctgccctgactcagccctcgctcagtgtccgggtctcctgggcagtcagtcaccatctcctgcactggaaccngcagtgatgtgtgtatgattgctctgtacacagcagccaggcagcccccaaatcatgatttatgatgcagtgcgcggccccctcggggtcctgactcgcttctcgtgctccatctgcacacgcctcctgacatctctcgctcgacgcctgagntgagcgtgattatacngcagcgnatacttacgacgccccagcggttacgttcggcgggcggaacgtaggtaacgtaccgtccgtcgggtacgtacgacccgaacggtcccg

SEQ ID NO: 443287 - DNA, 619 bp, Homo sapiens
  misc_feature: GZ8MTXP02HTCO6.10.59.F04.1.454.CMB.2.raw
  modified_base (232)..(232): a, c, t, g, unknown or other
  modified_base (274)..(274): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagccctcctcactcagggcacaggatcctgggctcagtctgccctgactcagccctcgctcagtcgtccgggtctccgtgggcagtcagtcaccatctcctgcactggaaccngcagtgatgttggtgtatgtattgtctctggtaccaacagcngccaggcgaacgccccctaaatcatgtattatgtatgtcgagtcgcgccggtcccccggtcggggtccctgactcgtccttctcgtcggtctccgtacgtcgtcggaccaaccgaccgtccctaccctgtacccatcccttcgtccggtccctccgaccgtccgtaggtacgtgtacggagtcgttaggttaactttacgttacttggttcgtactactagttagtcgtacgtcgggtacccgggttcgtcggtttacgggggtcggttcggggaacgggtacggggtaccaacgggtccggtaaccggttacccggtaccgtacggtaccacccggtaacccgg

SEQ ID NO: 443288 - DNA, 697 bp, Homo sapiens
  misc_feature: GZ8MTXP02JHIJH.10.59.F04.1.454.CMB.2.raw
  modified_base (214)..(214): a, c, t, g, unknown or other
  modified_base (273)..(273): a, c, t, g, unknown or other
  modified_base (529)..(529): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggccggcccccagatgggtcctgtcccagctgcagctgcatgagtccgggcccaggactgggtgaggccttcggatacccctgtcccctnagttgcgtctgtctcgtggtgctccatcaacagtgtgacaacgtggtggcgtgggtccnccgacggtcccccaaggggtatggggactgggacgtggtatttcggacccttacactagttagtacggtcggacctacccaactaacccaaccccgtcctacgaggtagtccgaagtccaaccattccacctaacgtacgacctacgtaccgaagtacctacctacccgttctaccccgtaggtccgtacgtaccctcgttacggtaccggacccgccgacggaccgaccggtccggttaggttatttagttcggnggaccgtacgaccggaacccccgtgtaacggaaacttacgtacctaactaaacggttcgtttaccgttaacggaccgttaaaccgggtcgggggacccgtaaaggggtcccgtacccggttcggggtttacccccaaccggtttccccaccgtacccggttaaccccg

SEQ ID NO: 443289 - DNA, 623 bp, Homo sapiens
  misc_feature: GZ8MTXP02GZFXX.10.59.F04.1.454.CMB.2.raw
  modified_base (210)..(210): a, c, t, g, unknown or other
  modified_base (228)..(228): a, c, t, g, unknown or other
  modified_base (239)..(239): a, c, t, g, unknown or other
  modified_base (243)..(243): a, c, t, g, unknown or other
  modified_base (262)..(262): a, c, t, g, unknown or other
  modified_base (582)..(582): a, c, t, g, unknown or other
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggactaccctgtccctnagttgcgctgtctctggngctcatcaacngtgngacacgtggtggctggccnccacgccccgagggatgggactggagtggattcggccttacactattagagtcggacctaacccactaaccaaccccgttcctacgacggagtcgacgtcaccatcctcaactagacaccgtccaaaggtactccgaccttcctcccgtaggaacggtctacccgtcgttcgacgacccgccggacgaccgaccggtccgttaggtaatttacgtcgggtacgacgacgaccgtaccccgatacggaaactacgtttaccctaactaaagtttcgttaactttacggaacctacgggttacgggggcccgaagggggccncccgttacgggtccctaacccggttcttcccgacgtacccg

SEQ ID NO: 443290 - DNA, 650 bp, Homo sapiens
  misc_feature: GZ8MTXP02F30BK.10.59.F04.1.454.CMB.2.raw
  modified_base (280)..(280): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtccaccatcctcctgcacgtggaaccagcagtgtagttggttggtggttatgtactttgtctccgtgtaaccaanagcacgccgaggaccgaaccgaccccctaaattcagttagtaatttatgtatgtcgaggtcgccgggtccggtccccccggttccgggggtcctaggtacttccggtcttcgtcgtcgtcctaccgagtcgtacggaccaccgccgtccctccctcgacctacttccgtccgtccggtccctccgaacgtccgtaggacgtagtcggaagtccttagttaacgtttacttacgttgtttcgtacgttactagtacgttcgacggtacggggtccgggttacccgtggtttacgggggtcgttacggggacggtaacgggaccgtaaggtccgtacggtaccggtacgtacggtacccacgggtaacccgg

SEQ ID NO: 443291 - DNA, 739 bp, Homo sapiens
  misc_feature: GZ8MTXP02F1S6H.10.59.F04.1.454.CMB.2.raw
  modified_base (233)..(233): a, c, t, g, unknown or other
  modified_base (253)..(253): a, c, t, g, unknown or other
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctgccctgactcagcctcgctcagtcggtccgggtctccgtgggcagtcagtccacatctcctgcactcggaaccngcagtgattggttggtgttntgtacttgtctccgtggtaccaacagcacgccgaggaccgaaaccgtaccccctaaattcactagtatttagtgtatgtacacgtcggcccggtccgggtccccccgtccgggggtccctgtaccgttccgtccttcgtcgtccggtcctaccgtagtccgtacggaacctacccgtaccggtccctaccccgtagaccctacgtcccgtccgtccggtacccctaccgtcgtacccgtaggtaaccggtaggcggtacggtcgttacgttaacgtttaacgttccggttggttcctagtttaccgtagttacgggttaacggcccggttaacggggtacccgggtttaccgggttacggggttttcgggggttacggttacccgggggaaccgggggtaaccggggtaaaacccgtcggggttacccgttaacccgggtacccggtttaccggtaacccgggccggtaaccccggtaacccgggg

SEQ ID NO: 443292 - DNA, 678 bp, Homo sapiens
  misc_feature: GZ8MTXP02FLT2F.10.59.F04.1.454.CMB.2.raw
  modified_base (342)..(342): a, c, t, g, unknown or other
  modified_base (447)..(447): a, c, t, g, unknown or other
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcacgcctcgctcagtcggtccgggtctccgtgggcagtcagtcaccatctcctgcacgtacggaaccagcaggtgtagttggttggtggttatgtactttgtcctccgtacggtaaccaacgacgcacgccgacggaccgaaaccgaccccctaaattccagttacgtatttagngtatgtacagtcggccggccggtccccccggtccggggtaccctgtactcgtcttcgtcgtcgctacagtcgtacgaccaccgaccgtccctacccgtacacctntcctccgtacggccctacgcgtaccgtaggtagagttacggcggtacttaggttaactttacgttacgttcgttacgtactactagttacgtcgggaccggtacgggtcccgggttaccggtcgggtttcgggggtcgggttacccggggacggggtaaccgggtaaccgtaaccggtccggtaaccgggtacccggttaccggtaacggacccggaacggtaaccccggg

SEQ ID NO: 443293 - DNA, 423 bp, Homo sapiens
  misc_feature: GZ8MTXP02HEWA2.10.59.F04.1.454.CMB.2.raw
  modified_base (235)..(235): a, c, t, g, unknown or other
  modified_base (323)..(323): a, c, t, g, unknown or other
  modified_base (396)..(397): a, c, t, g, unknown or other
  modified_base (399)..(399): a, c, t, g, unknown or other
  modified_base (401)..(401): a, c, t, g, unknown or other
  modified_base (403)..(403): a, c, t, g, unknown or other
  modified_base (408)..(408): a, c, t, g, unknown or other
  modified_base (410)..(410): a, c, t, g, unknown or other
  modified_base (413)..(413): a, c, t, g, unknown or other
  modified_base (415)..(415): a, c, t, g, unknown or other
  modified_base (417)..(423): a, c, t, g, unknown or other
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctnaatgtactttgaccatggggccaggggagccctggtcaccgtctcctcagccctccaccaacggcccaatcggtcttccccctggccncccctgctccaggagcacctcgagacgcacagcccggccctgggctgcctggtcaggctacttccactactanncngngnggcgngnagngnannnnnnn

SEQ ID NO: 443294 - DNA, 601 bp, Homo sapiens
  misc_feature: GZ8MTXP02H5QQJ.10.59.F04.1.454.CMB.2.raw
  modified_base (385)..(385): a, c, t, g, unknown or other
  modified_base (436)..(436): a, c, t, g, unknown or other
  modified_base (505)..(505): a, c, t, g, unknown or other
  modified_base (539)..(539): a, c, t, g, unknown or other
tcagcatagtagtgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgacttaataaactatgtcctacctaggtaacccaaacaacacccgaggacccacggccccagactcatacctagtttcaggatacgtcaggtcgtacgttcccggtccgttttagggtaactttactaagttcgtacctttcnctacgtccctacgtaaagtccgtacgaccaacgtacggtcccttacccgtnacccgtactccgtcccggccttacgacctcgtaggaaacgcgagtactactattacttcagcagtctanaattaacacgaccggaggctaccgtgtcgtaagnttaacgtcggggacgacggtctcggaacgtcgggaaccctccgtagaccacgaccgtaacgg

SEQ ID NO: 443295 - DNA, 385 bp, Homo sapiens
  misc_feature: NA.10.11.A11.1.454.heavy.2.nb
tcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctactattattacgagagatctgagtttgaccacgtggggccagggcatgctagtcaccgtctccccagcctccaccccaaggccatcggtcttccccctggccaccctcctccaagacgcacctctgggggcacgacgcggccctgggctgcctggtcaaggctacttcccactactatg

SEQ ID NO: 443296 - DNA, 344 bp, Homo sapiens
  misc_feature: NA.10.21.B10.1.454.heavy.2.nb
agaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcggtgggggaggcgtgggtccggccgtggggggtccctggagactctcctgttctgcgtctggattcatctttagtaaatctggcatgtcctgggtccgccaggttccaggccgacgggctggaagtgggtggccagatatacaatatgatgaacaagtaaaatatactataggagactccttcgaaggccgattacc

SEQ ID NO: 443297 - DNA, 351 bp, Homo sapiens
  misc_feature: NA.10.23.C01.1.454.heavy.2.nb
gagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagcttggtacagcctggcaggtccctgagactctcctgtgcagcctctggattcagctttgatgaatatgccatggactgggtccgcaagttccaggggaaggcctggagtgggtcctcgaggtattgattggaatgtggtaccattgcctatgcgactctgtgaagggcattcaccatcacagacgacgacgc

SEQ ID NO: 443298 - DNA, 290 bp, Homo sapiens
  misc_feature: NA.10.23.C01.2.454.heavy.2.nb
ttccagggaaggcctggagtgggtctcaggtattgattggaatagtggtaccattgcctatgcggactctgtgaagggccattcaccatcaccagagacgacgccaggagctccctgtatctccaaatgaacagtctgagacctgaggacacggccttgtattactgtagtaagagggagtcaggggtttcaactattatagtagtggttatgactacgtggggccagggaaccctggtcaccgtctcctcacgccctccaccaacgggccccagtccggtccttccccc

SEQ ID NO: 443299 - DNA, 364 bp, Homo sapiens
  misc_feature: NA.10.26.C04.1.454.heavy.2.nb
agactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagagtccgtggggcctcagtgaagatttcctgcaaggcgtccggatacaggttcaccgccgtctatattaatggctgcgacacggcccctggacaagggcctgagtggagtggggacaatcgaaccgagtggaggtggtgcagagtaccgccgagaggtttcgagggcagagtctcatgaccagtgacacgtccg

SEQ ID NO: 443300 - DNA, 400 bp, Homo sapiens
  misc_feature: NA.10.30.C08.1.454.heavy.2.nb
gagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgcacgtgggtccgcaagctccgaggggaaggcctgggagtgggtctcgtggaatcacttacaatagtgtatttacctaaatatgcggactctggtgagggggtctttcaccatctccagagacaacgccaggaactccctctactctaacaaatggaacagtctgagacctgag

SEQ ID NO: 443301 - DNA, 384 bp, Homo sapiens
  misc_feature: NA.10.34.D01.1.454.heavy.2.nb
agccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcagtaacgcctggatgaactgggtccgccaggctccgaggggaagggctggagtgggttggccatataaaatcaaagctagatggtaggacaacagagcacgctgcacccgtagaaaggcagatcagcatctacaagagatagaattacaaaaagtacgactgtaatctagaac

SEQ ID NO: 443302 - DNA, 600 bp, Homo sapiens
  misc_feature: NA.10.35.D02.1.454.heavy.2.nb
ggagccccagccctgggattcccaagtgtcttcattcagtgatcaggactgaacacagaggactcaccatggagtttggctgaggtggattttcctgctgctaattttaaaaggtgtccagtgtgacgtgcagttggtggagtcgtgggggaggtcttgggttaagggcccggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagacgtcccacgaagactggtagggaagggactggcgtcgggggccaggggacgccccttgtccaccgtctcctcacgccctccaccgaacgggccccatccggtcccttcccccgtggcccgccctgcctccaggacgccacctccgagacgcacacgccggccctggg

SEQ ID NO: 443303 - DNA, 454 bp, Homo sapiens
  misc_feature: NA.10.38.D05.1.454.heavy.2.nb
agcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgcaggctccgaggggaaggggctgggagtgggtctcagttatgaaacagatggcactacatattattctgactccgtgaacgggccgttcaccctctccagacgacacttccaaacaacatcttgtatcttcacatgcacaatctagagagtcgacgacacggccacctattatgtcgcgcgacatgactaacgctacaattcgcggggccagggaccg

SEQ ID NO: 443304 - DNA, 573 bp, Homo sapiens
  misc_feature: NA.10.38.D05.2.454.heavy.2.nb
agcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaattcgtggggccaggggacgcccaggtcaccgtcctccccagccctccaccaacgggccccatccggtccttcccccgtggccgcccctgcctccgaggacgccaccctccgagacgccaccacgccggccctgggctgcctggt

SEQ ID NO: 443305 - DNA, 324 bp, Homo sapiens
  misc_feature: NA.10.38.D05.3.454.heavy.2.nb
agcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgcaggctccgaggggaaggggctgggagtgggtctcagttatgaaacagatggcactacatattattctagactccggtagaacggggt

SEQ ID NO: 443306 - DNA, 364 bp, Homo sapiens
  misc_feature: NA.10.38.D05.4.454.heavy.2.nb
tccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatctttagtaaatctggcatgtcctgggtccgccaggttccaggccacgggctggaatgggtggcagatatacaatatgatgacagtaaaatatactatgagactcttcaagggccgattcaccatctccagagacaattccaaagacatggtgtatcttgacaaatcgaccagcctgagagccgga

SEQ ID NO: 443307 - DNA, 345 bp, Homo sapiens
  misc_feature: NA.10.42.D09.1.454.heavy.2.nb
gtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactccgtgggccagggaatcctggtcaccgtctcctcacgcctccaccgaacgggccccatccggtccttccccctggccgccctgcctccaggacgcacctcccgagagcacacgccggccctgggctgcctggtcaaggctacttcccactactatg

SEQ ID NO: 443308 - DNA, 347 bp, Homo sapiens
  misc_feature: NA.10.44.D11.1.454.heavy.2.nb
cactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcctgtgcagcctctgggttcaccttcagtagctacggcatgcacgtgggtccccaagcctccgaggcaaggggattgggaggtggggtggctaggtttgttcagtcgtggacgggcaggttgttacaagtggtatgcagactcgtgaacgggccattcaccatctcagagac

SEQ ID NO: 443309 - DNA, 563 bp, Homo sapiens
  misc_feature: NA.10.5.A05.1.454.heavy.2.nb
cagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagattagcagcgactggctcggctggtgcgccagatggcccggggaaggcctggagtggatggggatcatcaatcttggtagctctgaaaccagatacaccccgtcttccaacggccgggtcaccatctcagccgacaggtccatcagtactacctactggagtggattagcctgaaggcctcggacaccgccatgtattactgtacgagacttgaacggggattctattatggcgcgatctggggccagggaaccctggtcaccgcctcctcagcctccaccaagggcccatcggtcttccccctggcaccctcctccaagagcacctctgggggcacagcggccctgggctgcctggtcaaggactacttcccactactatg

SEQ ID NO: 443310 - DNA, 315 bp, Homo sapiens
  misc_feature: NA.10.53.E09.3.454.heavy.2.nb
ttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgtcgggccattcaccatctaccaaagacaatttgaagaacacgctgtttctgacaaatgaaacagcctgagacgctgaggacacggctgtgtattactgttcgttg

SEQ ID NO: 443311 - DNA, 357 bp, Homo sapiens
  misc_feature: NA.10.55.E11.2.454.heavy.2.nb
ccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctgagtgaagtatttcctgcaaggcgtccggatacaggttcaccgccgtctatattaatggctgcgacaggcccctggacaagggcctgagtggagtggggagaatcaaccgagtggaggtggtgcagagtcgccagaggtttcagggcagagtctccatgaccagtgacacgtccgcgagcactgtctatatggaga

SEQ ID NO: 443312 - DNA, 565 bp, Homo sapiens
  misc_feature: NA.10.59.F04.1.454.heavy.2.nb
agagtcatggacctcctgtgcaagaacatgaatcacctgtggttcttcctcctgctggtggcggccccagatgggtcctgtcccagctgcagctgcatgagtcgggcccaggactggtgaggccttcggatacccctgtcccctcagttgcgctgtctctggtgctccatcaacagtgtgacaactggtggggctgggtccgccagcccccaggggatggggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagacgaccccgctgaagattcctcaatgtactttgaccactggggccaggggagccctggtcaccgtctcctcagcctccaccaagggccccatcggtcttccccctggccgccctgcctccaggagcacctccgagagcacagcccggccctgggctgcctggtcaggctacttcccatactatg

SEQ ID NO: 443313 - DNA, 260 bp, Homo sapiens
  misc_feature: NA.10.6.A06.1.454.heavy.2.nb
agccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggccgtgggtcgaaggccgggggggtctcgtgagactgtcctgtgttgcctctgcttccctctcaggtagtttcagcatgaacgtgggtccccaggctccgaggggacgggcctgg

SEQ ID NO: 443314 - DNA, 342 bp, Homo sapiens
  misc_feature: NA.10.60.F05.1.454.heavy.2.nb
  modified_base (155)..(155): a, c, t, g, unknown or other
  modified_base (260)..(260): a, c, t, g, unknown or other
tctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggcagttacttcttagataacgtgggggcccggggaaccctggtcgccgtctctcagccctccaccaacgggccccatccggtccttcccccgtggcnccctgcctccaggacgccacctccgagagccacacggccccggccctgggctgcctggtcaaggctacttcccactactatg

SEQ ID NO: 443315 - DNA, 558 bp, Homo sapiens
  misc_feature: NA.10.71.G05.1.454.heavy.2.nb
gagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatctttagtaaatctggcatgtcctgggtccgccaggttccaggccacgggctggaatgggtggcagatatacaatatgatgacaagtaaaatatactatggagactccttacaagggccattcaccatctccagagacaattccaagaacatggtgtatctgacaaatgaccagcctgagagccgaggacacgggttgtttattacgtgtgggagtaaatcctagtggcatccacctggtattgtgacttccggggcagggaaccgtggtcacgtctctcggcctccaccaggcccatcggtctccccgtgccgccctcgctccaggacggcacccgtccgagacg

SEQ ID NO: 443316 - DNA, 331 bp, Homo sapiens
  misc_feature: NA.10.71.G05.2.454.heavy.2.nb
gagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatctttagtaaatctggcatgtcctgggtccgccaggttccaggccacgggctggaatgggtggcagatatacaatatgatgacagtaaaatatactatggaacgtactccttacgaagg

SEQ ID NO: 443317 - DNA, 346 bp, Homo sapiens
  misc_feature: NA.10.77.G11.1.454.heavy.2.nb
ggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaaggcccatccggtcttccccctggccaccctcctccaagacgcacctccgtgggggcacagcggccctgggctgcctggtcaaggactacttcccactactatcg

SEQ ID NO: 443318 - DNA, 527 bp, Homo sapiens
  misc_feature: NA.10.79.H02.1.454.heavy.2.nb
agaggagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctggagggtccctgagactctcctgtgcagcctctggattcgcctcgtggattgacgttcagtgactactacatgacctgggtcccgccgaggcctccgaggggaaggggctgggagtggggttaccatactatttacctagtggtgataccatatactacgcagactctgtgaagggccgattcaccatctccagggacaacgccaagaactcactgactttgacaaatgaacaccctgcgagccgaggacacggccgtatattactgtgcgagaataacccgttcgccttggttattaccttgacacgttggggccaggggaaccctggtcaccgtctcctcacgcctccaccaacgg

SEQ ID NO: 443319 - DNA, 592 bp, Homo sapiens
  misc_feature: NA.10.85.H08.1.454.heavy.2.nb
aggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccgccaggctccgagggaaggggctggagtgggtggccaccataaaggaagatggaagtgagaactactttgtgggctctgtgaagggccgattcaccatctccagagacaacgccaaagaagtcactgtatctgcaaatgaacgatgtgagagtcgaggacacggctgtatatttctgtgcgaggggagccggctatggttcggacctcgtggggccagggaaccctggtcaccgtctcatcagcctccaccaagggcccatccggtccttccccctggccgccctgcctccaggagcacctccgagagcacagcggccctgggctgcctggtcaaggctacttcccactctatg

SEQ ID NO: 443320 - DNA, 373 bp, Homo sapiens
  misc_feature: NA.10.87.H10.1.454.heavy.2.nb
gagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtcgtgggggaggcgtggtccagccgtgggggtccctgagactctcctgtgcagcctctggattcgacttcgaaatgtctggcatgcacgtgggtccgccaggctccgaacggaaggggctgggagtggggtggctagttctttcatttgataggaaaaaagggatattatgcgcctcgtgaagggccattcagcatctccagagacatttaccgaagccacggtgta

SEQ ID NO: 443321 - DNA, 348 bp, Homo sapiens
  misc_feature: NA.10.9.A09.2.454.heavy.2.nb
  modified_base (304)..(304): a, c, t, g, unknown or other
agcactagaagtcggcggtgtttccattcggtgatcagcactgaacacagaggactcaccatggagtctgggctgaactgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtcgggtcccaccaaactccaggcaaggggttgggagtggggtggctagtttgttcatctgagggcagtgttcaaagtggtntgctgacgccgtagaagggccgatcaccatctccagagacaact

SEQ ID NO: 443322 - DNA, 386 bp, Homo sapiens
  misc_feature: NA.11.10.A10.1.454.heavy.2.nb
tcatgagggtgtcctcggctctcaggctgttcatttgcatatacatcattttcttggaattgtctctggagatggtggtagcagatacttcgcagactccgtgaagggccggttcaccatctccagagacaattccaaagaaaatgatgtatatgacaaatgaacagcctgagagccgaggacacggccgtatattctgtgcgaaagatcgggcatatagtgcctacgacctggggattgatgtcttttgatatcgtggggaccaagggacaagtggtcaccgtctcttcagcctccaccgaagggcccatccggtccttcccccgtcggcccacccctccctacccaaagacgcctaacccgtcgtcgggggaccacgacgccgg

SEQ ID NO: 443323 - DNA, 498 bp, Homo sapiens
  misc_feature: NA.11.13.B02.1.454.heavy.2.nb
ttttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctggagtgggtggccaacataaagccagatggaggtagtaaaacagtatgtagactctggtggagggccggttcaccatctccagagacaacgccaaagaatgcgatatatctacagatgaacagcctgcgagccgaggacacggctgtgtattactggtgggatccctggctggcacctgtactccgacgttggagtcgagggaactcgtggtccaccgtctcctcacgccctccaaccgaacgggcccagtccggtccttcccccgtggcccgccctcgcctcccgaggacgccacccgtccgagacgcacacgacggccctgggctgcctggtcaaggcta

SEQ ID NO: 443324 - DNA, 403 bp, Homo sapiens
  misc_feature: NA.11.19.B08.1.454.heavy.2.nb
tagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccgccaggctccgagggagggctggagtgggtttcatacatttctagtaattctggtaccccatacactatgcagtctctgtgaagggccgattcaccatctccagagacaacgccaggaactcacttatctagacaaagtgagcagcctagagagtcgaaggacacgggttatt

SEQ ID NO: 443325 - DNA, 326 bp, Homo sapiens
  misc_feature: NA.11.20.B09.1.454.heavy.2.nb
ctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccccctgggctgcctggtcaaggctacttccgtatctctcg

SEQ ID NO: 443326 - DNA, 331 bp, Homo sapiens
  misc_feature: NA.11.21.B10.2.454.heavy.2.nb
  modified_base (245)..(245): a, c, t, g, unknown or other
ggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacagcctctggcttcaccttcatacctatggcatgcacgtgggtccnccagacctccgaggcgagggggctgggagtgggtgctagttattcatatgataggaaatgtagacttctattcagtactccggtag

SEQ ID NO: 443327 - DNA, 369 bp, Homo sapiens
  misc_feature: NA.11.22.B11.1.454.heavy.2.nb
attggggaaatcaatgatagtggaagcaccaactacaacccgtccctcaagagccgagtcaccatatcagtagacacgtccaagaaccagttctccctgaagttgacctccgtgaccgccgcggacacggctgtgtattatgtgcgagaggggttaatggcgccttaatgatgacccgggcgcggccggtgtacaagtgggagggtagttacagtggacgtcgtggggaacaaagggaccacagtcatcgtctccgcagcttccaccaagggcccatcggtcttccccctggcgccctgctccaggagcacctctgggggcacgcggcccgtggggctgcctggtcaaggactacttccgtatctctcg

SEQ ID NO: 443328 - DNA, 432 bp, Homo sapiens
  misc_feature: NA.11.23.C01.1.454.heavy.2.nb
tacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacgggcgtgtattttgtgccagagaagaggatattgctctgatggtgtctgctattacgtctacggtttggacgtctggggccaaggggccacggtcatcgtctcctcacgcctccaccaagggcccatccggtccttccccctcggccaccctcctccaagacgcacctcgtcgggggcacgacgcggcccgtgggctcgcctggtcaaggctacttccgtatctctcg

SEQ ID NO: 443329 - DNA, 440 bp, Homo sapiens
  misc_feature: NA.11.26.C04.1.454.heavy.2.nb
gtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggatccctggctggcacctgtactccgacgttgagtcagggactctggtcaccgtctcctcacgccctccaccaacgggcccatccggtcccttccccctcggccgcccctcgcctccgacggacgccaccctccgacgacgcaccgacgccggcccgtgggcctcggcccgtcgggtaccgaa

SEQ ID NO: 443330 - DNA, 451 bp, Homo sapiens
  misc_feature: NA.11.27.C05.1.454.heavy.2.nb
agccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattactctacggaaccccgatcgtt

SEQ ID NO: 443331 - DNA, 390 bp, Homo sapiens
  misc_feature: NA.11.27.C05.2.454.heavy.2.nb
agccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcatccattagtagtaatagtgcctacagatactacgcagactcactgaagggccgactcaccatctccagagacaacgccaagaactcactgtatctgcaaatgaacagcctgagacga

SEQ ID NO: 443332 - DNA, 445 bp, Homo sapiens
  misc_feature: NA.11.28.C06.1.454.heavy.2.nb
gttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaactcactatatctggaaatgactagcctgagactcgaggacacggccgtttattactgtgcgacgcccgccgatagcagcatcatctactggggccaggggaccctggtcaccgtctcctctgcctccaccaagggcccatccggtcttcccccgtggccgccccgtcgcctccgaaggac

SEQ ID NO: 443333 - DNA, 310 bp, Homo sapiens
  misc_feature: NA.11.37.D04.1.454.heavy.2.nb
ggcaaggacttgagtggatgggacagatccacccttacactggcgacacaatttatgcacagaaatttcagggcagatttaccctgaccgaggacacggccatcaccacagtctacatggacctgaagagactgacaattaacgacacggaccaaatattattgtgtcagagacaagactctaattttgtgttcgtggtcactgctggttccgaccccgtgggccagggaccctgatcaccgtctcctctcgccctccaccaagggccccatccggtccttcccctggccacccctcccctccaagacgc

SEQ ID NO: 443334 - DNA, 448 bp, Homo sapiens
  misc_feature: NA.11.38.D05.1.454.heavy.2.nb
gtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccgttcaccatctccagagacaattccatgaacacgctgtatctgcaaatgaacagcctgagagccgaggacacggccgtatattactgtgcgcagatagattgtagtggtggtagctgctacgtgggggccaggggaccctggtcaccgtctcctcacgcctccaccaacggcccatccggtccttccccctcggccacccctcctcccaagacgccacctcgtcgggggcacgacgccggcccgtgggcctcgcctggtcaaggctacttccgtatctctcg

SEQ ID NO: 443335 - DNA, 379 bp, Homo sapiens
  misc_feature: NA.11.39.D06.1.454.heavy.2.nb
atgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaacgggcccatccggtcccttccccctggccacccctcctccaagcgccacctcgtgggggcacgagcggccctgggctgcctggtcaaggctacttccgtatctctcg

SEQ ID NO: 443336 - DNA, 425 bp, Homo sapiens
  misc_feature: NA.11.57.F02.2.454.heavy.2.nb
agaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggagcttagtccaggccggggggtccctgagactctcctgtctagtctctggattcgccttcagtgactatgccatgaagtgggtccgccaggctccgagggtaaggggctaggaatggatttcatacattagcagtagtggtgcgaccatatactacgcagactctgtgaagggccgattcatcatctccagagacaatggacaacaactcactgtatctaggaaactcaacagcctagagagtcgaggacacggctgtatattatgtgacga

SEQ ID NO: 443337 - DNA, 287 bp, Homo sapiens
  misc_feature: NA.11.59.F04.2.454.heavy.2.nb
  modified_base (194)..(194): a, c, t, g, unknown or other
  modified_base (239)..(239): a, c, t, g, unknown or other
ggagcccagcactagaagtcggcggtgtctccattcggtgatcagcactgaacacagaggactcaccatggagtttgggctgaactgggttttcctcgtagctcttttaagaggtgtccagtgtcaggtgcaactggaggagtcgtgggggaggcgtggtccagccgtgggacgtccctgagactctctgtacngcctctggcttcaccttcattacctatggcatgcacgtgggtccnccagacctccgaggcgagggggctggaggtgggtgctagtttatttcc

SEQ ID NO: 443338 - DNA, 429 bp, Homo sapiens
  misc_feature: NA.11.6.A06.1.454.heavy.2.nb
gccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaagccggggggtcccttagactctcctgtgcagcctctggcatcactttcagtgacgcctggatgagctgggtccgccaggctccgaggggaagggctggagtgggttggccgtattaaaagcgaggctgctggtggacaacagactacgctgcacccgtgaagggcagatcaccatctaccagagatgattcaaggagcacagtgtttactaacaaatgaacagcctgactggccggggacacgtgccgtgtattactgtcgccagcagcagca

SEQ ID NO: 443339 - DNA, 322 bp, Homo sapiens
  misc_feature: NA.11.61.F06.1.454.heavy.2.nb
gtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcaccagcggccctgggctgcctggtcaaggctactccgtatctctcg

SEQ ID NO: 443340 - DNA, 644 bp, Homo sapiens
  misc_feature: NA.11.67.G01.1.454.heavy.2.nb
gagaggagcccagccctgggattttcaggtgttttcatttggtgatcaggactgaacagagagagctcaccatggagtttgggctgagctggtcttttctgtggctatttaaaaggtgtccagtgtgaggtggagttattgcagtcgtggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtgcaactgctacgacgcctactattatcaccacatggacgtcgtggggcaaagggaccacggtcatcgtctcctcacgcctccaccaacgggcccatccggtccttccccctcggcccaccctcctccaacgacgccacctcgtcgggggcacgacgccggccctgggctgcctggtcaaggctacttccgtatctctcg

SEQ ID NO: 443341 - DNA, 344 bp, Homo sapiens
  misc_feature: NA.11.70.G04.2.454.heavy.2.nb
gattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtattgttagggacctcactacggtatggacgtctggggccaagggaccacggtcaccgtctcctcagcctccaccaagggcccatccggtccttccccctggccaccctcctccaagagcacctctgggggcacagcggccccctgggctgcctggtcaaggctacttccgtatctctcg

SEQ ID NO: 443342 - DNA, 440 bp, Homo sapiens
  misc_feature: NA.11.71.G05.1.454.heavy.2.nb
agaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgagactctcctgtacagcctctggcttcaccttcattacctatggcatgcacgtgggtccccagacctccgaggcgagggggctgggagtgggtgctagttattcatatgataggaaatgtgacttctattcagactccgtgaacgggccgtattccaccgtctccagagacattccaggcacacgctgtatctgacaaatgaacagcctgagagctgaggacacggctgtgtacttacgtgtacgacgaaagtattaactatagaggtgacgta

SEQ ID NO: 443343 - DNA, 448 bp, Homo sapiens
  misc_feature: NA.11.72.G06.1.454.heavy.2.nb
accacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccaggcgagtcaccctgaccacagagacatccacgaccacagtctacatggagctgtggagcctgagacctgacgacacggccctgctacttactgtgcgaaggcccttatccttacacgtcgaccactccaacgctcggttccgacctcgtcgg

SEQ ID NO: 443344 - DNA, 422 bp, Homo sapiens
  misc_feature: NA.11.73.G07.1.454.heavy.2.nb
cttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtccgccaggctccgtggggaaggggccgagtggatttcatacatcagtagtagtggtaacaccttgtactatgcagactctgtgaagggccgattcaccatctccagagacaacgccaagaattcactgtttctgcaaatgaacagcctagagagacgaggataacggcttatttactattgtgcgcgatcga

SEQ ID NO: 443345 - DNA, 459 bp, Homo sapiens
  misc_feature: NA.11.85.H08.1.454.heavy.2.nb
ctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccgagggaaggcctggagtggcttggttatgtccacacagaggatcccttactacaacccgtcactcaagagtcgacttaccatatcactccgacacgtccaggaatcagttctccctagaaactgagtccgtcattgtcgcggacacagccgtctattattgtgtcagagatccggcccataactggctcggcccctggggcccggaacctggtccaccgtctcctcacgcctccaccaacgggcccatccggtccttccccc

SEQ ID NO: 443346 - DNA, 375 bp, Homo sapiens
  misc_feature: NA.11.86.H09.2.454.heavy.2.nb
gctgttcccagtgtaatcgatatacccaatccactccagaccctgtccctcacctgcactgtctctggtgcctccatcagtagttattactggagctggatccggcagcccccagggaagggactggagtggattgggtatatcgattacactgggaacagcaatttccaaccccgccctcaagagtcgagtcaccatatcagtagacacgtccaagaaccacttctccctgaggctgacctctgtcgaccgctgtggacacggccgtctattactgtacgagatccaaatgattacatcgactgggttccgacccctgggggcccaggggaaccctggtccaccgtctcctcacgccctccaccaacgggccca

SEQ ID NO: 443347 - DNA, 435 bp, Homo sapiens
  misc_feature: NA.13.10.A10.2.454.heavy.2.nb
ccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagcagattcatcatctcgagaggtgattccgacaacacggtgtctctccatatgagcagcctagaaaatcgaggacacaggcctatacttactgtgcagtgatgggccacgaccacgtactttggagtggtgcgctcgacccgtcggggccccggaacccgtcggtccaccgtctcctcacgccctccaccgaacgggccccagtcccggtcccttcccccgtcggcccacccctccctacccaacgacgccacc

SEQ ID NO: 443348 - DNA, 425 bp, Homo sapiens
  misc_feature: NA.13.10.A10.3.454.heavy.2.nb
  modified_base (415)..(415): a, c, t, g, unknown or other
cttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagcgtgggtccgccaggctccgaggggaaggggctgggagtggggtggccaacataaagcaagttggaagtgaagaaatactatgtggactcgtgttaagggccattcaccatctccagagacaacgccaaagactcactgtatctgacaaatgaaacagcctagagagccgaaggcacggctgtctattacngtgacgagag

SEQ ID NO: 443349 - DNA, 403 bp, Homo sapiens
  misc_feature: NA.13.12.B01.1.454.heavy.2.nb
gggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttatactgtgcgtaggtttatgtgttggaacgtggtaccacggaaatggtcgaccctggggccaggggaaccctggtcgtcgtctcgtctgcctcaccaagggcccatccggtccttccccgtggccgccctgctccaggacgccacctccgagacgccacgacgcc

SEQ ID NO: 443350 - DNA, 476 bp, Homo sapiens
  misc_feature: NA.13.21.B10.1.454.heavy.2.nb
ctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctctgggttcagcttcagtgtatattggatgagctgggtccgccagactccgaggggaaggggctgggagtgggtggccaacataaacacagacggaagtgacccatactatgcggactctgtgaagggccgattcaccatctccagagacaacgccaaagaactcactatattgacaaatggaccgctgagagacgagacacggctatgtattactgtgcgagagatggagagtcggctacgaaggttcgggggacccggggtaaccctgggtaccaccggttcaaaccg

SEQ ID NO: 443351 - DNA, 248 bp, Homo sapiens
  misc_feature: NA.13.21.B10.3.454.heavy.2.nb
agctggtggagtctggaggaggcttgatccagccgtgggggtccctgagactctcctgtgcagcctctgggttcaccgtcagtcacacctacatgagctgggtccgccaggctccgaggggaaggggctggagtgcgtctcttttattatagtagtggtagtaccatactccgcagactccgtgaggggccgattcaccatctccagagacaattccaaagaacacgcttgtttctacaaaatgaaac

SEQ ID NO: 443352 - DNA, 331 bp, Homo sapiens
  misc_feature: NA.13.23.C01.1.454.heavy.2.nb
ctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgaggacactgccatttatactgtgtgagagtattctttccttgactacggtacttctgtccttgactactggggccagggaacccctggtcagcgtctcctcagcctccaccaagggccccatccggtcttccccccgtggccgcccctgcctcccaggacgccaccctccgagacgcacagccg

SEQ ID NO: 443353 - DNA, 317 bp, Homo sapiens
  misc_feature: NA.13.23.C01.2.454.heavy.2.nb
gtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccaggacaactccaaagaacaccttatatctgcagatgaaacagcctgagaggtgacgactcggctgtatacttctgtgcgaacaaactgatgtttggagtggatgtgttacttctaccatacggaatgggacgtcggt

SEQ ID NO: 443354 - DNA, 286 bp, Homo sapiens
  misc_feature: NA.13.23.C01.3.454.heavy.2.nb
gccagtggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtctcccctggcgccctgctccaggagcacctccgagagcacagcggccctgggctgcctggtcaaggactactcctagtacgtga

SEQ ID NO: 443355 - DNA, 265 bp, Homo sapiens
  misc_feature: NA.13.23.C01.4.454.heavy.2.nb
ttcaggttccagctcacatggaaaatactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctctggtgctccttcagcagtggtagtttctacgtggagcgtggactcccggcacggccccggaccggggaaggg

SEQ ID NO: 443356 - DNA, 325 bp, Homo sapiens
  misc_feature: NA.13.24.C02.1.454.heavy.2.nb
ggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggccaccctcctccaagacgcacctctgggggcacagcggccctgggctgccttgtcaaggctacttcctagtacgtga

SEQ ID NO: 443357 - DNA, 339 bp, Homo sapiens
  misc_feature: NA.13.25.C03.1.454.heavy.2.nb
acccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgaggcctcagtgaaggtctctgcaaggcttccggataccaccctcaatggaaactatgtccactatgtgcgacaggccccaggacaagggcttcgtgtggagtggggtgatcaaacctaatagtggtcgacaacaaactatagaaagaaagtaagtttggaacggggtccgggtacaaccagtcga

SEQ ID NO: 443358 - DNA, 439 bp, Homo sapiens
  misc_feature: NA.13.28.C06.1.454.heavy.2.nb
gagaggagccttagccctggactccaaggcctttccacttggtgatcagcactgagcacagaggactcaccatggaattggggctgaactgggttttcctgttgctattttagaaggtgtccagtgtgaagtgcacctggtggagtccgggggagacttggtccagcctggggggtccctgagactctcctgtgtagcctctggatttgttttagtgactattggatggagttgggtccgccaggctcgagggaggggctggagtgggtggccaacataaagtacgatgaagttgagataaattattggactctgtgaggggccattcaccatctcgagggacaacgccaagaactcgctgtatctgacaaaatggagagcctgagagccgaggacacggctgtatattattgtgtgagattacgcgacacttactttg

SEQ ID NO: 443359 - DNA, 464 bp, Homo sapiens
  misc_feature: NA.13.33.C11.1.454.heavy.2.nb
cagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtgccacaaagtttgcacagtaactttcaggacagggtcaccatgaccacggacacgtccatcaacacagcctacatagggaactgaggagacctaagatctgacgacacggtccgtttattattgtgtaaattaagaattagacaaacgagttgcttttaagattaagtggtggggaccaaggggtt

SEQ ID NO: 443360 - DNA, 392 bp, Homo sapiens
  misc_feature: NA.13.33.C11.3.454.heavy.2.nb
ctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactgggctggatccggcacgcccccgagggaagggctggagtggagttggggatatctcttatagtgggagtacgaactacaatccgtccctacaagacgtcgagtcatcatatccgtagacaggtccaggaacgaattctaccctagaaagtgagttctgtcgaccgtcgcagacacggctgtctattatgtgcgagacgg

SEQ ID NO: 443361 - DNA, 440 bp, Homo sapiens
  misc_feature: NA.13.35.D02.1.454.heavy.2.nb
  modified_base (334)..(334): a, c, t, g, unknown or other
agccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagcctggggggtccctcagactctcctgtgcaacctctggattcattttctctgacgcctggttgagctgggtcccgccaggcctcccgggaagggctggagtgggtggccgtattaaaggtagaagacagtggtcggacaacagactaccagtgttcccgtagaaaggcagnttcactatctcaagagatgactacaaaagaaatgaatatatctagacaaatgaaacaacctaggaaaagcgaaggacacaggcgtagtaattactgtaccacagaa

SEQ ID NO: 443362 - DNA, 354 bp, Homo sapiens
  misc_feature: NA.13.36.D03.3.454.heavy.2.nb
ggaagtgctttctgagagtcatggacctcctgcacaagaacatgaaacacctgtggttctgcctcctcctggtggcagctcccagatgggtcctgtcccaggtgcagctacagcaagtggggcgcgagggctgttgaagccttcggacgaccctgtccctcacgtgcgctgtctcgtgggtggttcttcagtggttactacgtggagctggatccgccagtccccgagggaagggctggagtggagttggggaaatcaatcatagtggaagcaccaacctaccaaccgtccctcgagacgccgagtcaccatgtcagtagacacgtccaaagaaccagttctcccgtgacgggt

SEQ ID NO: 443363 - DNA, 523 bp, Homo sapiens
  misc_feature: NA.13.37.D04.1.454.heavy.2.nb
gagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagcctggggggtccctgagactctcgtgtgcagcctctggatttagttttagcagttatgccatgagctgggtccgccaggctccgagggaaggggctggagtgggtttcgggtattagtgctcttgatgatagcacatactatgcagactccggttaagggccgcttcaccatctccagagacaattccaaagaacacgctatatctgcagatgaacagcctgggagccgaggacacggccgtttatcactgtgcgaaagatattgtaatgatggtagctgctactactactttttgactacgtggggccagggaaccctggtcaccgtctcttcagcctccaccgaacgggccca

SEQ ID NO: 443364 - DNA, 421 bp, Homo sapiens
  misc_feature: NA.13.38.D05.4.454.heavy.2.nb
aggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtccctcagactctcctgtgcaacctctggattcattttctctgacgcctggttgagcgtgggtcccgccgaggccgtccccggggaagggcgtgggaggtggggtggccgttagttaaaggtagaagacagtggtcggacaacagactacagtgttcccgtagaaaggcagattcactatctcaagagatgactacaaaagaatgaatatatctagacaaatgaaacaacctagaaaagcgaaggac

SEQ ID NO: 443365 - DNA, 435 bp, Homo sapiens
  misc_feature: NA.13.39.D06.2.454.heavy.2.nb
tgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcacgcccgcgggaaggactgggagtggattgggcttatcaatgccaggtggggcaccgagctaccaacccccctccctacaagacgccgcgtcacctatttcagtagacacgtaccaaagaaccagctctccctgaagctgagttctgtcgaccgccgcagacacggccgtgtatactgtgcgcgacaggtggacgtcgtggggaccaaggggaccacggtcaccgtctc

SEQ ID NO: 443366 - DNA, 348 bp, Homo sapiens
  misc_feature: NA.13.39.D06.4.454.heavy.2.nb
ggagtggagccccagccttgggattcccaagtgtttgttttccgtgatcaggactgaacacacaggactcaccatggagttggggctgagctggattttccttcttgctatgttagaaggtgtccagtgtgaggtgcactggtggagtcgtgggggagcttggtacagccgtggggggtccctgagactctcctgtgcagcctctggattcaccttcagtacctacgacatgcactgggtccgccaacctcgtaaggaaaacggtccggagtgggtctcgagggattggctaggtgttggtgacactattctattcagactccggtgaacgggccgattccaccatct

SEQ ID NO: 443367 - DNA, 334 bp, Homo sapiens
  misc_feature: NA.13.4.A04.1.454.heavy.2.nb
gaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaaggcccatcggtctcccctgcaccctcctccaagcgcacctctggggcacacgcgccctgggctgcctggtcaaggactacttcctagtacgtga

SEQ ID NO: 443368 - DNA, 449 bp, Homo sapiens
  misc_feature: NA.13.40.D07.1.454.heavy.2.nb
  modified_base (252)..(252): a, c, t, g, unknown or other
cccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctcaaagcgggacgaccgactataacccgttttaggagtcgagtctcgatttcaatagacaggtctaagacacaattctccctgagggtnacctctatgtcggccgcggacgcggccgtctattactgtcgcgcgaggatctccgtcggacacttcgtagacaaggcaaaacgtccgaagtcgttatcacttgactccgtgggccacgggaaccctggtcagcgtctcttcagcctccaccaaggccatcggtcttcccctgccaccctcctccaacgacgcacctc

SEQ ID NO: 443369 - DNA, 332 bp, Homo sapiens
  misc_feature: NA.13.42.D09.1.454.heavy.2.nb
attgggtacatctattacagtgggactacctactataatccgtccctcacgagtcgagtgaccatatcagtagacacgtctgagaaccagttctccctgaaactgagttctgtgactgccgcggacacggccgtgtattattgtgcgagaggtcgagtggatggttcagggtattcttttgactacgtggggccagggaaccctggtcaccgtctcctcagcctccaccaagggcccatccggtccttccccctggccaccctcctccaagagcacctctgggggcacagcggccctgggctgcctggtccaaggactactcctagtacgtg

SEQ ID NO: 443370 - DNA, 315 bp, Homo sapiens
  misc_feature: NA.13.42.D09.2.454.heavy.2.nb
attgcatacatgagtggaggtggagccaccagatactacgcagagtctgtgaaggaccgtttcatcatttccagagacaacgccaagaactctctgttcctacaaatgaatcgcctgagccccgaggacacggctgtctactactgcgggagacgaggctttgactacgtggggccaggggaaccctggtcaccgtctcctcagcctccaccaagggcccatccggtccttccccctggccaccctcctccaagagcacctctgggggcacagcggccctgggctgcctggtccaaggactactcctagtacgtg

SEQ ID NO: 443371 - DNA, 220 bp, Homo sapiens
  misc_feature: NA.13.42.D09.3.454.heavy.2.nb
gtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgattctctggggccagggggacaagtggtaaaccgtctcttcagcc

SEQ ID NO: 443372 - DNA, 338 bp, Homo sapiens
  misc_feature: NA.13.46.E02.1.454.heavy.2.nb
attggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgtacttttggagtggtgcgctccgaccccgtggggccccggaaccctggtccaccgtctcctcacgccctccaccgaacgggccccagtccggtccttccccccgtggccacccctcctccaaagcgccccacctcgtgggggccacgaacgccggcccgtggg

SEQ ID NO: 443373 - DNA, 361 bp, Homo sapiens
  misc_feature: NA.13.55.E11.2.454.heavy.2.nb
ccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttcgactctcctgtgcagcctctggaatcactttcagtgacgcctggatgaactgggtccgccaggctccgagggaaggggctggagtggattggccgtattaaaagtgagcctgatgggtggacaacagactacgctgcacccgtgaagggcagattcaccatctccagagatgattacaaggaaca

SEQ ID NO: 443374 - DNA, 357 bp, Homo sapiens
  misc_feature: NA.13.59.F04.3.454.heavy.2.nb
aagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaatagaagtacagtgtgtatgagttggattcgtcagtccccagggaagccctgggagtggcttgcacgcattgattgggatgatgatacaaaatataacaacacatctatgaagaccaggctacaccatctaccaaggacatcttacacgtagacc

SEQ ID NO: 443375 - DNA, 297 bp, Homo sapiens
  misc_feature: NA.13.59.F04.4.454.heavy.2.nb
catagtgggaccacctactacagcccgtccctcaatagtcgcgtcaccatgtcagtggacgagcccaagaaccagttctccctgagcctgacctctgtaaccgccgcggactcggccctatacttctgtgcgagagatcgagatgtgtcatcgcggggcacttttgatatctggggccaagggtcgatggtcatcgtctcttcagcctccaccaagggcccatcggtcttccccctggccgccctgctccaggacgcacctccgagacgcacagccgccctgggctcgcctggtcaa

SEQ ID NO: 443376 - DNA, 258 bp, Homo sapiens
  misc_feature: NA.13.60.F05.2.454.heavy.2.nb
ttggggaaatctatcatagtgggaccacctactacagcccgtccctcaatagtcgcgtcaccatgtcagtggacgagcccaagaaccagttctccctgagcctgacctctgtgatcgccgcggactcggccctatacttctgtgcgagagatcgagatgtgtcatcggcggggcacttttgatatcgtggggccaaggggtcgatggtcatcgtctcttcagcctccaccaagggcccatcggtcttcccccgtggcc

SEQ ID NO: 443377 - DNA, 300 bp, Homo sapiens
  misc_feature: NA.13.61.F06.1.454.heavy.2.nb
gtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgtactacgttgtcggctggggcgactttgactagtttggggccaagggcacgtggtcaccgtctccccaagccttccaccaacgggcccatccggtccttccccctggccgccctgcctccacgga

SEQ ID NO: 443378 - DNA, 340 bp, Homo sapiens
  misc_feature: NA.13.62.F07.1.454.heavy.2.nb
  modified_base (285)..(285): a, c, t, g, unknown or other
gcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccggagggggggcctggagtggcgttggaagcatctctacaaagcgggacgaccgactactaacccgtntttaggagtccgagtctcgatttcaatagcaggtctaaagacacaattctccctg

SEQ ID NO: 443379 - DNA, 429 bp, Homo sapiens
  misc_feature: NA.13.64.F09.1.454.heavy.2.nb
tgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtgatccggcagcccccggggaagagctggagtggagtggggaggatttatatactggcaatacttacgacaatccgtccctcaagagtcgagtcaccctgtccgtggacacgccccgaataacagttcctccctagaaagtcgacctctgtcgaccgtcgcagacacggcctatttattattgtgtgagatacgacttttggaaatggctagtgactcgatcgactacgtcggggccctaggaactccgt

SEQ ID NO: 443380 - DNA, 284 bp, Homo sapiens
  misc_feature: NA.13.67.G01.2.454.heavy.2.nb
aggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcactttgatgattatgccatgcacgtgggtccgcaagctccgaggggaagggcctgggagtggggtctcgaggtattag

SEQ ID NO: 443381 - DNA, 336 bp, Homo sapiens
  misc_feature: NA.13.70.G04.1.454.heavy.2.nb
gtctcagatattagtggtagtggtggtagcacatctcatgtagactccgtgaagggccggttcaccatctccagagacaattccaagaacacgatgattctgcaaatgaacagcctgagagtcgaggactcggccctttattactgtgtagaaaagaactaccatgacgcgcgggccttttgactactggggccagggaattctggtcaccgtctcctcagccctccaccaagggccccatcccgtcttccccctggccgccctgctccaggcgccacctccgagagcacagcccggccctggggctgcctggtcaaggctacttccagtacgtga

SEQ ID NO: 443382 - DNA, 261 bp, Homo sapiens
  misc_feature: NA.13.71.G05.4.454.heavy.2.nb
tggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctcgtgggttcagtcttcagtgtatattggatgagcgtgggtccgcagactccgaggggaggggctgggaggtgggt

SEQ ID NO: 443383 - DNA, 358 bp, Homo sapiens
  misc_feature: NA.13.76.G10.3.454.heavy.2.nb
gggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccacggtcaccgtctcctcagccctccaccaagggccccatcggtccttccccctggccgcccctgcctccaggagcacctccccgagagcacagccggccctggggctgcctggtcaagggactacttcctagtacgtga

SEQ ID NO: 443384 - DNA, 289 bp, Homo sapiens
  misc_feature: NA.13.76.G10.4.454.heavy.2.nb
cactgggattccgaggtatttccattcggtgatcagcactgaacacagaggactcaccatggagttttggctgagctgggttttccttattactattttaaaggtgtccagtgtgaggtgcagttggtggagtctggaggaggcttgatccagccgtgggggtccctgagactctcctgtgcagcctctgggttcaccgtcagtcacacctacatgagcgtgggtccgccgaggctccgagggaggggctggagtgcgtctcttttattatagtagtggtagtacatac

SEQ ID NO: 443385 - DNA, 293 bp, Homo sapiens
  misc_feature: NA.13.76.G10.5.454.heavy.2.nb
cagcactgggattccgaggtgtttccattcggtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagcctccgaggggaacgggcctgggagtggggtctcgaggttattaggttaggaatggt

SEQ ID NO: 443386 - DNA, 331 bp, Homo sapiens
  misc_feature: NA.13.77.G11.1.454.heavy.2.nb
gattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactacgtggggccaggggaaccctggtcaccgtctcctcaccctccaccaagggcccatcggtctccccctggcaccctcctccaagagcacctctgggggcacagcggccctgggctgcccctggtcaaggctacttcctagtcgtga

SEQ ID NO: 443387 - DNA, 299 bp, Homo sapiens
  misc_feature: NA.13.78.H01.1.454.heavy.2.nb
catagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcggcggggcacttttgatatctggggccaagggtcgatggtcatcgtctcttcagcctcaccaagggcccatcggtctcccctggcgccctgctccaggagcacctcgagagcacagcgcctgggctcgcctggtcaaggctaacttc

SEQ ID NO: 443388 - DNA, 611 bp, Homo sapiens
  misc_feature: NA.13.79.H02.1.454.heavy.2.nb
aggagccttagccctggactccaaggcctttccacttggtgatcagcactgagcacagaggactcaccatggaattggggctgagctgggttttccttgttgctattttagaaggtgtccagtgtgaggtgcagctggtggagtcggtgggggaggcttggtccagccgtggggggtccctgagactctcctgtgcagcctctggattcacctttagtagctattggatgagctgggtccgccgaggctccgaggggaaggggctgggagtgggtgccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattggggcgaaggtatagcagtggcacgtactactttgactactggggccagggaaccctggtcaccgtctcctcagcctccaccaagggcccatcggtcttccccctggcaccctcctccaagagcacctctcggggcacagcggccctgggctgcctggtcaaggctacttcctagtacgtga

SEQ ID NO: 443389 - DNA, 355 bp, Homo sapiens
  misc_feature: NA.13.79.H02.2.454.heavy.2.nb
  modified_base (311)..(311): a, c, t, g, unknown or other
aggagccttagccctggactccaaggcctttccacttggtgatcagcactgagcacagaggactcaccatggaattggggctgagctgggttttccttgttgctattttagaaggtgtccagtgtgaggtgcagctggtggagtcggtgggggaggcttggtccagccgtggggggtccctgagactctcctgtgcagcctctggattcacctttagtagctattggatgagctgggtccgccgaggctccgaggggaaggggctgggagtgcgtctcttttattatagtagtggtagtacatactccgcngactcgtgaggggccattcaccatctccagagacaattcccaaa

SEQ ID NO: 443390 - DNA, 413 bp, Homo sapiens
  misc_feature: NA.13.85.H08.1.454.heavy.2.nb
acaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacacggcccctgggccaaggtcttgagtggatgggactaatcactcccaatggtgatgggactgcctacgcacagaagtttcagggcagagtcaccatgaccagggacacgtccacgagaacagactagttggagttgagcagcctgagatctgacgacacggtcgtttatactgtcgcgcgagataagtagt

SEQ ID NO: 443391 - DNA, 399 bp, Homo sapiens
  misc_feature: NA.13.86.H09.1.454.heavy.2.nb
accacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttaacgaacggaaacacagactatggaacagaacctcagggcagattcaccatgacgacagacacatacagacacagacctacatggaggtgaggagcctgagatatgacgacacggccgtagtattattgtgcgtag

SEQ ID NO: 443392 - DNA, 330 bp, Homo sapiens
  misc_feature: NA.13.86.H09.2.454.heavy.2.nb
cccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctccaccaagggcccatcggtcttcccctggcaccctcctccaagagcacctctgggggcaccagcggccctgggctgcctggtccaaggctacttcctagtacgtga

SEQ ID NO: 443393 - DNA, 373 bp, Homo sapiens
  misc_feature: NA.13.87.H10.2.454.heavy.2.nb
gagaggagccccagccctgagattcccaggtgtttccattcagtgatcagcactgaacacagaggactcaccatggagttgggactgagctggtattttcctttggctatttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagctccgaggggaggcctgggagtgggtctcgaggtattagttggaataggtggtagcagtaggctagtggcggtactcgtggtaggaagggccgattccgacctatcgtccagacgacaacgccaaag

SEQ ID NO: 443394 - DNA, 318 bp, Homo sapiens
  misc_feature: NA.13.9.A09.2.454.heavy.2.nb
  modified_base (234)..(234): a, c, t, g, unknown or other
cagccgtgagattcccaggagtttccacttggtgatcagcactgaacacagaccaccaaccatggagtttgggcttacttgggttttccttgttgcttattttaaaaggtgtccaatgtgagctgcagctggtggagtcgtgggggaggtttggtacagccaggggcggtccctgagactctcctgtataacttctggattcaacttgggtattatgctatgaacgtgggtccncaggctccgagggagggctggaggtgggtagtttcagttaggagtctaattctacattgagtgggaacaacgagaactacgccg

SEQ ID NO: 443395 - DNA, 597 bp, Homo sapiens
  misc_feature: NA.15.1.A01.1.454.heavy.2.nb
gcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccggggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccagtggggccagggaaccctggtcatcgtctcgtcagcctccaccaagggcccatcggtcttccccctggcacccctcctccaacgacgcacctcgtcgggggcacgacgccggccctgggctgcctggtcaaggctacttccgctacgtaga

SEQ ID NO: 443396 - DNA, 509 bp, Homo sapiens
  misc_feature: NA.15.16.B05.1.454.heavy.2.nb
aggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccaggctccagggaaggggctggagtgggtggccaccataacaaaaagatggaagtgacacaacctatgtgaactctgtgatgggccgattcaccgtctccagagacgacgccaaagaactcactacatctgacaaatgaacaacctgagagccgaggacacggctgtgtattactgtgtgagagatgttctggtcggttggggccaggggaaccctgggtcaccgtctcctcacgccctccaccgaacgggcccatcggtccttccccc

SEQ ID NO: 443397 - DNA, 380 bp, Homo sapiens
  misc_feature: NA.15.2.A02.1.454.heavy.2.nb
  modified_base (228)..(228): a, c, t, g, unknown or other
tgtgcagcgtctggattcaccttcagaagttggggcatgcactgggtccgccaggctccaggcaaggggctgcaatgggtggcgctaatatgggatgacggaagtaaggaatattatgcagactccgtgaaggccgattcaccatctccagagacaattccaagaagacgctgtttctgcaaatgaacagcctgagagtcgaggacacggctgtatattattgtgcgngaggaggggttgtagcacgggtcacgtggactacgtggggccacgggaaccctggtccaccgtctcctccgccctccaccaggggccccagtccggtccttcccctgccaccctcctccaacgacgcacctcgtcgggacacacgccggccc

SEQ ID NO: 443398 - DNA, 383 bp, Homo sapiens
  misc_feature: NA.15.20.B09.1.454.heavy.2.nb
ccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatggtctcctgcagtgcttctggttacattctttccaccttacggtatgaattggttgagacaggcccccggagaggggcttgagtggatgggatggatcgagcccttaacggaaactaaaacagagtatgcagagaacgttccgagggcagagtcatcatcaccgcggacacatccacgagtacagcctacatggaactgaggagcctcagatcgtagacgacacggcactt

SEQ ID NO: 443399 - DNA, 594 bp, Homo sapiens
  misc_feature: NA.15.28.C06.1.454.heavy.2.nb
cagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgagggcccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaccctggtcaccgtctcctcagcctccaccaagggccccatccggtccttcccccgtggccgccctgcctccaggacgccacctccgagacgcacagccggccctgggctgccgtggtcaaggactacttccgctacgtaga

SEQ ID NO: 443400 - DNA, 371 bp, Homo sapiens
  misc_feature: NA.15.30.C08.1.454.heavy.2.nb
  modified_base (362)..(362): a, c, t, g, unknown or other
agccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagcctgggggtccctgagactctcctgtacagtctctggattcaccttcagtagttatggcatgaactgggtccgccaggctccgaggggaggggctggagtgggtctcatccagttagtgctggaagtagttacatctactacgcagactcagtgaggggccattcacatctcagagacaacgccagggactcagtgtaantctgacaaa

SEQ ID NO: 443401 - DNA, 595 bp, Homo sapiens
  misc_feature: NA.15.34.D01.1.454.heavy.2.nb
ggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggaggcttggtccagccgtggggggtccctgagactctcctgtgcagcctctggattcagttctagtaaatactggataagttgggtccgccaggctccagggaagggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggagggccggagtggtatttggatactttctggggccaggggaccctggtccaccgtctcctcagcctccaccgaagggcccatccggtcttccccctggcgccctgcctccaggagcacctccgagagcacagcggccctgggctgcctgggtacaaaggctacttccgctacgtaga

SEQ ID NO: 443402 - DNA, 361 bp, Homo sapiens
  misc_feature: NA.15.37.D04.1.454.heavy.2.nb
  modified_base (210)..(210): a, c, t, g, unknown or other
aagactgatggtccccccaggaactcaggtgctgggcatgatgggcatggggaccatctatcctgctgactctgataccaaatacagcccgtccttccaaggccaggtctccttctcagccgacaggtccatctctaccgcctacctgcagtgggacagcctgaagacctcggacaccgccatgtattactgtgcgactacaggacgtcngagttacgtggggaccagggaaccccaggtcaccgtctcctcacgcctccaccgaagggccccactcccgtccttccccctggccgccctgcccctccgaggcgccaccctccgagcgcacgagccggccctgggctgccctggtcaaggc

SEQ ID NO: 443403 - DNA, 624 bp, Homo sapiens
  misc_feature: NA.15.38.D05.1.454.heavy.2.nb
  modified_base (132)..(132): a, c, t, g, unknown or other
  modified_base (155)..(155): a, c, t, g, unknown or other
gaggagccttagccctggactccaaggcctttccacttggtgatcagcactgagcacagaggactcaccatggaattggggctgagctgggttttccttgttgctattttagaaggtgtccagtgtgaggtncagctggtggagtcgtggggganacttggtccaggcccggggggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagagtgggtaacaaaaggggaggggacttacgtttgactacgtgggggccggggaaccctggtcaccgtcctcctcagcctccaccaagggcccatcggtccttccccctggccaccctcctccaagacgccacctcgtgggggcacgagccggccctgggctgcctggtcaaggactacttccgctacgtaga

SEQ ID NO: 443404 - DNA, 432 bp, Homo sapiens
  misc_feature: NA.15.40.D07.1.454.heavy.2.nb
  modified_base (291)..(291): a, c, t, g, unknown or other
tggaatttgggctgagctggattttccttgctgctattttaaaaggtgtccagtgtgaggtgcagctggtggagtctgggggaggcttggtaaagccgggggggtcccttagactctcctgtgcagcctctggattcgctttcagtgacgcctggatgacctgggtccgccaggctccgagggagggctggagtgggtgcatataaagcaatgatgaaggtggacaccagaccacgctccaccgtgaaaggcagattcaccatctacaagagatgaattaaccaaaaaacncgctgtctacctaccaatcgaaacaacctagaacgaccgagacacagccgtagtattactgtaccaccgtgtcgggcctacgtactccgatggtgtctttgatatcgtggggaccaagggacaatggtcaccgtctcttca

SEQ ID NO: 443405 - DNA, 350 bp, Homo sapiens
  misc_feature: NA.15.41.D08.1.454.heavy.2.nb
ggtctcatccattagtagtggtagtgatttcagatactacgcagactcagtgaagggccgatttaccgtctccagagacaacaccaagaactcactctttctccacatgaacagcctgagagccgacgacacggctgtttattactgtgcgagagacaacgaggttcttagtcttgagacggctactagtttttgacttactttgactactggggccagggaactctggtctccgtctcctcagcctccaccaagggcccatccggtcttccccctggcaccctcctccaagagcacctcctgggggcacagcgccctgggctgcctggtcaaggctacttcccgctacg

SEQ ID NO: 443406 - DNA, 564 bp, Homo sapiens
  misc_feature: NA.15.55.E11.1.454.heavy.2.nb
agagaggagcccagccctgggattttcaggtgttttcatttggtgatcaggactgaacagagagaactcaccatggagtttgggctgaactggtctttttcttgtggctattgtaaaaggtgtccaatgtgaggtgcagctgttggagtctgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtagaaaacacatattacgcaggctccgtgaagggccgcttcaccatctccagagacaattccaaacaacacactttacttacaaatgaacagcctgcgagccgaggacacggccgtatactactgtgcgagagatcgaacaggcccccgtgggacgcccgttgactacgtggggccaggggaaccctggtccaccgtctcctcaacctccaccaacggcccatccggtccttcccctggccacccctcctccaacgacgccacc

SEQ ID NO: 443407 - DNA, 464 bp, Homo sapiens
  misc_feature: NA.15.67.G01.1.454.heavy.2.nb
gaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaaggggctggagtgggtggccaacataaaacaaagacggaagtacaagaaaaacctatagtggactctgtagacgggccgattcaccatctccagagacaacgccaaagaattcactgtatttgacaaatgaaacagcctgagaggcgaggacacggccgtgtattatgtgcgcgagatgatagtagactctacaagtagcaggtgta

SEQ ID NO: 443408 - DNA, 471 bp, Homo sapiens
  misc_feature: NA.15.67.G01.2.454.heavy.2.nb
gaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaaggggctggagtgggtggccaacataaaacaaagacggaagtacaagaaaaacctatagtggactctgtagacgggccgattcaccatctccagagacaacgccaaagaattcactgtatttgacaaatgaaacagcctgagagaggcgaggacgacggccgtgtattattgtgcgcgagatgatagtagactctacaagtagcgaggtgtagt

SEQ ID NO: 443409 - DNA, 457 bp, Homo sapiens
  misc_feature: NA.15.67.G01.3.454.heavy.2.nb
gaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaaggggctggagtgggtggccaacataaaacaaagacggaagtacaagaaaaacctatgtaggactctgtgacggccgattcaccatctccagagacaacgccaaagaattcactgtatttgacaaatgaaacagcctgagaggcgaggaccgacggccgtgtattattgtgcgcgagatgatacgtagactctacaagta

SEQ ID NO: 443410 - DNA, 350 bp, Homo sapiens
  misc_feature: NA.15.67.G01.4.454.heavy.2.nb
gaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaaggggctggagtgggtggccaacataaaacaaagacggaagtacaagaaaaacctatagtaggactcgtagtagaacggccgattccaccatc

SEQ ID NO: 443411 - DNA, 332 bp, Homo sapiens
  misc_feature: NA.15.67.G01.5.454.heavy.2.nb
gaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaaggggctggagtgggtggccaacataaaacaaagacggaaagtacaagaaaaacctatagtaggaactcgtaggt

SEQ ID NO: 443412 - DNA, 445 bp, Homo sapiens
  misc_feature: NA.15.70.G04.1.454.heavy.2.nb
tgggcccttggtgaagccttcggagaccctgtccctcacctgcactgtctctggtgactccatcagtccttactactggacctggatccggcagcccccagggaagggactggagtggattggatatatctattacagtggggcaccaactacaacccctcctcaagagtcgagtcatcatttcagtagacacgtccaagaaccagttctccctgaagatgagctctgtgaccgccgctgacacggccgtctattattgtgcgagacatcggcaccgtaagttcggtccgaccccgtggggccacggggaacccggtcacccgtcgcctcacgcctccaccgaacgggccccagtccggtccttcccccgtcggcccacccctcctcccaacgacgccacccgtcgtcgggggccacgacggccggccccgtgggcctcggccgt

SEQ ID NO: 443413 - DNA, 331 bp, Homo sapiens
  misc_feature: NA.15.77.G11.1.454.heavy.2.nb
gataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacggagggtagacggtgaccggggctcgtttgactactggggccagggaatcctggtcaccgtctcctcggcctccaccaagggcccatcggtcttccccctggcaccctcctccaagagcacctctgggggcacagcggccctgggctgcccctggtcaaggactacttccgctcgtaga

SEQ ID NO: 443414 - DNA, 262 bp, Homo sapiens
  misc_feature: NA.15.8.A08.2.454.heavy.2.nb
  modified_base (152)..(152): a, c, t, g, unknown or other
tgtgccgcctctggagcagagtctgaattcaccttcatgcactttgccatgagctgggtccgccaggcgtccggggaaggggctggagtgcgtcgcatgtaataaactaaaagtggagacatcacactctacgcagactccgtgaagggccncttcaccatctcagagacaactccaagaacacgctgtccctggagatgaacagcctgagagccgaggacacggcctatttatactgtgacgaaagagttaggttacgggg

SEQ ID NO: 443415 - DNA, 368 bp, Homo sapiens
  misc_feature: NA.15.80.H03.1.454.heavy.2.nb
ccgaaggcttcaccagccctggacctcctgtgcaagaacatgaaacatctgtggttcttccttctcctggtggcagctcccagatgggtcctgacccaggtgcagctgcaggagtcgggcccaggactggtgaagccttcggagaccctgcccctcacctgcactgtctctggtgctccatcagtacttactactggagctggatccggcagcccccagggaaggactggagtggattgggtatatctattacagtggagcaccaactaccaacccctcctacaacgagtcgagtcaccatgtcagtagacacgtcaagaaccaagtctccctgagttgacctctgtgaccgctgcgacacggccgtg

SEQ ID NO: 443416 - DNA, 537 bp, Homo sapiens
  misc_feature: NA.15.86.H09.3.454.heavy.2.nb
gagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgaagaaaatagactacggtgcaccgtgaaaggaagattcaccatctcaaagagaataattacaaaaacgacggtgtatttgacaaatgaacagcctagaaaaccgaggacacagccgtctattactgtaccacagattcggaagtgcatcgaacgtaaaggaggctagtgtcttttgatactcgtggggcccaggggacaagtggtcgtcgtctcttcagcctccaccgaacgggccc

SEQ ID NO: 443417 - DNA, 623 bp, Homo sapiens
  misc_feature: NA.15.87.H10.1.454.heavy.2.nb
gaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtgccaacataaagcaaagatggaagtgaagaaatactatgtggactctgtgaagggccgattcaccatctccagagacaacgccaaagaacttactgtatctgacaaaatgaaacagcctgagaggcgaggacaccggctctgtattactgtgcgaggactacctcctcgtgggccgggcctacggtttcctacggcagtggacgtcgtggggccgaagggaccacggtcaccgtctcctcacgcctccaccaacgggcccacgtccggtccttcccccgtcggccacccctcctccaacgacgccacctcgtcgggggcacgaacgccggcccgtcgggcctcgcctggtaccg

SEQ ID NO: 443418 - DNA, 456 bp, Homo sapiens
  misc_feature: NA.17.10.A10.2.454.heavy.2.nb
ccctccttgggagaatcccctagatcacagctcctcaccatggactggacctggagcattccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggagaagggcttggagggtggggtggggtgggtcgaggcggtcgtttggacggtaaggcacgagtatgccaccgaagataggaagggcaggtcacgattaccacggacacccccagaacacagtctacatgacaactgacgagcctgagagctgacgacacgggccgtctattactgtgcgagaattgtttctgtcatcgtactaatttgataggctctatggactggacttcgt

SEQ ID NO: 443419 - DNA, 454 bp, Homo sapiens
  misc_feature: NA.17.10.A10.3.454.heavy.2.nb
ccctccttgggagaatcccctagatcacagctcctcaccatggactggacctggagcattccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggagaagggcttggaggtggggtggggtgggtcgaggcggtcgtttggacggtaaggcacgagtatgccaccgaagataggaagggcaggtcacgattaccacggaccacccccacgaacacagtctacatgacaactgacgagcctgagagctgacgacacgggcctctattactgtgcgagaatgtttctgtcatcgtactaatttgataggctctatggactggacttcgt

SEQ ID NO: 443420 - DNA, 363 bp, Homo sapiens
  misc_feature: NA.17.23.C01.1.454.heavy.2.nb
aggagccttagccctagattccaaggcctatccacttggtgatcagcactgagcaccgaggattcaccatggaactggggctccgctgggttttccttgttgccctttttggaggtgtccaatgtgaggtgcagctggtggaatcgtgggggaggcctggtcaagccgtggggggtccctgagactctcctgtacagcctctggattcaccttcaagaactacaacatgcactgggtccgccaggctccgaggggaagggactggagtgggtctcatccattagtagtggaagtagtaccatatattccgagagtcagtgaagggccgttcacatctcagagacaacgcaaagactcactctt

SEQ ID NO: 443421 - DNA, 452 bp, Homo sapiens
  misc_feature: NA.17.25.C03.2.454.heavy.2.nb
ttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccagatccggtgacgcctacggcagcggcctttgactt

SEQ ID NO: 443422 - DNA, 311 bp, Homo sapiens
  misc_feature: NA.17.27.C05.2.454.heavy.2.nb
ccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggcacctttagcaactatgcttcagctgggtgcgacaggcccctggacaagggcttgagtggagtgggaggatcattcctatccttggggactaggtaaggtactccaacagaacgttccaggggccaaa

SEQ ID NO: 443423 - DNA, 467 bp, Homo sapiens
  misc_feature: NA.17.28.C06.2.454.heavy.2.nb
agagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctgggggtccctgagactctcctgtgcagcctccggattccccttcagtagttattggatgacttgggtccgccagactccgaggggaaggggctggagtgggtggccaacataaagcaagatggaactgcccgtagttttacgggactctgtgaagggcctttcaccatctccagagacaacgccaaagaattcactgtatctaacaactgaaacagcctagagagtcgcagacacggccgtgtattactgtgcgagatgtaggaaaaagtatggctgtgttaagtggggaccagggga

SEQ ID NO: 443424 - DNA, 329 bp, Homo sapiens
  misc_feature: NA.17.31.C09.2.454.heavy.2.nb
ccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggatctctgaggatctcctgtaagggttctggatacaggttttccagctactggatcacctgggtgcgccagaagcccggtaaaggcctggagtggatggggagattgactccagtgactctcacatacaactaccacgtccccgtccttccaaggccacgtcaccatctcagct

SEQ ID NO: 443425 - DNA, 454 bp, Homo sapiens
  misc_feature: NA.17.33.C11.1.454.heavy.2.nb
tgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgccccaggaaggccctggagtggcttgcgctcatttattgggatgagagtaagcactacagtccgtctctgaagaacaggctccaccatcaccaaggaccacctccacaaaccaggtcgtaccttacaatgaaccaatatggaccctgtgacacagccacatattactgttcacgtctctagtgggttcgggattattacgtcccttatttgactacgtggggccagggactcgtcggtccaccgtctccgcacgcctccacc

SEQ ID NO: 443426 - DNA, 458 bp, Homo sapiens
  misc_feature: NA.17.34.D01.2.454.heavy.2.nb
acaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactaccgcacagaagttccagggcaagactcaccataaccgcggaacaaataacgaacacagtaatctagagctagaacagcctgtacatctgaggacacgggcttctacttctgtgcgaggagtaattactataacactagcttccttttacaccttcccttgtaccttcgtcggg

SEQ ID NO: 443427 - DNA, 291 bp, Homo sapiens
  misc_feature: NA.17.36.D03.2.454.heavy.2.nb
aggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtaccgccgtggggggtccctgagactctcctgtagagcctctggattcgccttcagtacctacagcatgaactgggtccgccaggttccaggggaagggtctgggagtgggttgcatacattagtagtagt

SEQ ID NO: 443428 - DNA, 357 bp, Homo sapiens
  misc_feature: NA.17.78.H01.2.454.heavy.2.nb
ttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccacggcccccggacacagccttgagtggatgggatggatgaacgttgacaagtgggaatacgagatatcacagaaattccgagggcagagtcacatacagggacacatccgcgaacacagcctacatagag

SEQ ID NO: 443429 - DNA, 325 bp, Homo sapiens
  misc_feature: NA.17.80.H03.1.454.heavy.2.nb
accacacccctccttgggagaatcccctagatcacagctcctcaccatggactggacctggagcatccttttcttggtggcagcagcaacaggtgcccactcccaggttcaactggtgcagtctggaggtgaggtgaagaagcctggggcctcagtgaaggtctcctgcaaggcctctggttacacctttaccaactatggtattagttggtgcggcaggcccctggacaagggcttgagtggatgggatggatcagccctaacattaggaaaacaaattatgcacagaggcctccgagggtagagtcaccctgaccacagacac

SEQ ID NO: 443430 - DNA, 642 bp, Homo sapiens
  misc_feature: NA.19.10.A10.1.454.heavy.2.nb
gccttggggttcccgagtgttttcgttcagtgatcaggactgaacacgtaggactcaccatggagtttggcctgagttggattttcctttctgctattttaaaaggtgtcctgtgtgaggtgcgcctggtggagtcgtgggggaggcgtggtccaggcccggggggtcctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcaacaaagtacagtgtatctgacaaatgaacagcctagaagaccgaggacacagccatttactattgtaacaaatgaaatacgtagggggaaacgggggaaaattgggggaccaggggaaccctggtccctccgtctcgtcacgccctccaaccgaaacgggcccatccggtccttccccctggcccgcccctgcctcccaggacgcacctccgagacgccacaggccggcccctggggcctgcccgtgggtacccgaaacgggtacccttaaccgttccccgaaacggacggta

SEQ ID NO: 443431 - DNA, 413 bp, Homo sapiens
  misc_feature: NA.19.13.B02.1.454.heavy.2.nb
gaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtagctatggcatgcactgggtcccaggctccaggcaaggggctggagtggggtgccagttatatcatatgatgggaaataaataaatactatgcagactccgtagaagggccgattcaccatctcagagacaattccaagaacacgctagtatctgacaaatgaacagcctagagagctagacggacacggctgtgtat

SEQ ID NO: 443432 - DNA, 357 bp, Homo sapiens
  misc_feature: NA.19.15.B04.1.454.heavy.2.nb
cggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtcgaccacaacatggactgggtcccgccgaggctccgaggggaagggctgggagtgggtcgcgtataccgaaggaagctaaacagttacagtacagaatacggcgcgtctagtagaaaggaggttcaccatctacaagaga

SEQ ID NO: 443433 - DNA, 428 bp, Homo sapiens
  misc_feature: NA.19.17.B06.1.454.heavy.2.nb
cttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtgggggtccctggcgactctcctgtgtggtctccggattcccattcagtcactatagtatgatgtggcccgcgaggcgtccggggaagggctggaatggcttgcattcccttggttggagtggaattaatacacaccacgcagactcagtgaggggccggttcaccatctccagagacaacgccaagagtacaatgtatttacaaatgaacagcctgagagccgaggatacggctgtgtattagttgt

SEQ ID NO: 443434 - DNA, 295 bp, Homo sapiens
  misc_feature: NA.19.2.A02.1.454.heavy.2.nb
tggacctcctgcacaagaacatgaaacacctgtggttcttcctcctcctggtggcagctcccagatgggtcctgtcccaggtgcagctacagcagtggggcgcaggactgttaaagccttcggagaccctgtccctcacctgcgctgtctatggtggtccttcagaggttactacgtggagttggatccgcacgccccgagggaggactggagtggagttggggaaatcaatcagtagtggaagcgccagctacaacccgtccctacaagagtcggctcgacatatagtagacac

SEQ ID NO: 443435 - DNA, 349 bp, Homo sapiens
  misc_feature: NA.19.25.C03.2.454.heavy.2.nb
tgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 443436 - DNA, 562 bp, Homo sapiens
  misc_feature: NA.19.26.C04.1.454.heavy.2.nb
ccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccccaggctccaggcaaggggctagagtgggtggcagttatatcatatgatggaagtaaaatatattatggagactcgtgaaggccgattcaccatctccagagacaattccaaagaacacagtggatctgacaaatgaaacagcctgagagcgtggggacacgggctgtgtattactgtgcgagagcggctggacaactacatccatttacggtttggacgtcgtggggaccaaggggaccacgggtcatccgtcctccccagccctccaccgaacgggcccagtccggtccttcccccgtggccgccccgtgcctccgacggacgcacccg

SEQ ID NO: 443437 - DNA, 257 bp, Homo sapiens
  misc_feature: NA.19.36.D03.2.454.heavy.2.nb
ggaagaggaagactgacggtcctgccacaggtggtgctgggcacggtgggcactcgacacaacatttgcgctcaactgtcttgtccactctcagggtcagctggtgcagtctggagctgaggttaagagccgtggggcctcagtgaaggtcgcctgcaaggcctctgattacacctttagcaactacggcatcaccgtgggtcgcgacacggcccctaggacgaagggcttgaggtggagtgggatggatcgagcgt

SEQ ID NO: 443438 - DNA, 484 bp, Homo sapiens
  misc_feature: NA.19.48.E04.1.454.heavy.2.nb
agaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctcctttagtagttattggatgaactgggcccgcaggctccgggggaaggggccggagtgggtggccaacataatgcaagatggaactgaagaaaaactagtgggggactcgtgtggaaagggccgattcaccatctccagagacaaccgtaagaacttactgttctgacaaatgaacagcctggagagccgaggacacggctgtgtattatgtgcggaagggcaggtggcgtggggacagtggacgtcgtggggccaaggggccacgggtcaccg

SEQ ID NO: 443439 - DNA, 607 bp, Homo sapiens
  misc_feature: NA.19.53.E09.1.454.heavy.2.nb
gagaggagccccagccctgagattcccaggtgtttccattcagtgatcagcactgaacacagaggactcaccatggagttgagactgagctggtattttccttttggctatttaaaaggtgtccagtgtgaagtgcagctggtggagtcgtgggggagcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaaagaactccctgtatctgacaaatgaacagtctgagagctgaggacacggccttgtattactgtgcaaggaggtatagcagctactggtacgactacgtggggccagggaaccctggtcaccgtctcctcacgcctccaccaacgggcccatccggtccttccccctggccgccctgcctccaggacgccacctccgagagcacaggccggccctgggccctgcctggtacaaggactactcccagagagta

SEQ ID NO: 443440 - DNA, 391 bp, Homo sapiens
  misc_feature: NA.19.59.F04.1.454.heavy.2.nb
cagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagcctggagggtccctgagactctcctgtgcagcctctggattcaccttcagtagttatgaaatgaattgggtcccaggctccgaggggaggggctggagtgggtttacatacattagtagtagtggtagtagcatatactacgcagactctgtgaagggccgattcaccatctccagagacagcgccaagactcactgtatctgacaaatgaacagcctgaa

SEQ ID NO: 443441 - DNA, 460 bp, Homo sapiens
  misc_feature: NA.19.67.G01.1.454.heavy.2.nb
aggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccgagggaagaggccggaggtgggtcgcgtaggttatttttagagggtgggaccgacattcgtacggagactccagtgggagggccgattcaccatctccagagtacttttctcagaacacactgtctcttacaaatgaaacagcctgacgggccgaggacacggccgtctattattgtgtgagtagtttattggcgagttggctgggtggaca

SEQ ID NO: 443442 - DNA, 451 bp, Homo sapiens
  misc_feature: NA.19.67.G01.2.454.heavy.2.nb
aggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccagggaagaggccggagtcgcgtaggttatttttagagggtgggaccgacattctacggagactccagtgggagggccgattcaccatctccagagtacttttctcagaacacactgtctcttacaaatgaacagcctgagggccgaggacacggccgtctattattgtgtgagtagtttattggcgagttggctgggtggaca

SEQ ID NO: 443443 - DNA, 402 bp, Homo sapiens
  misc_feature: NA.19.71.G05.10.454.heavy.2.nb
ctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatatttcatgtccaacacgtaggaaatacaaattatgacaccatctgttgagagtcgactgacaatcaaacgtagacacatacgaagaaccagttctaccctgcagctgacctctagtgacctcccgaggacaacgggg

SEQ ID NO: 443444 - DNA, 400 bp, Homo sapiens
  misc_feature: NA.19.71.G05.11.454.heavy.2.nb
ctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatatttcatgtccaaacgtggaaatacaaattatgacaccatctgttgagagtcgactgacaatcaaacgtagacacatacgaagaaccagttctaccctgcagctgacctctagtgacctcccgaggacaacgggg

SEQ ID NO: 443445 - DNA, 292 bp, Homo sapiens
  misc_feature: NA.19.80.H03.2.454.heavy.2.nb
ggtggccaacataaagccagatggaagtgagagatcttatgtggactctgtgaagggccgattcagcatctccagagacaacgccaagaattcactgtttctgacaaaataaacagcctgagagccgaggacacggctgtctactattgtgtgagagaggataagaattacttttgatttcgggggccaggggacaacggtcaccgtctcttcagccctccaccgaacgggccccagtccggtccttcccccgtggccgccctgcctccgaggacgccacctccgagacgca

SEQ ID NO: 443446 - DNA, 337 bp, Homo sapiens
  misc_feature: NA.19.81.H04.1.454.heavy.2.nb
aaggtgagtctgtcctggaatttctgtgacaacattgtcacagaaattccaggacagactcaccttgaccacagagacatccgcgaatacagcctacatggacctgggcagcctgacgtctgaagacacggctacatattattgtgtgagagattggaatcgggagactaactggagtcgtgacgttctttcgacccctggggccaggggacctcggtcattgtctcctcagcctccaccaaggcccatcggtcttcccccggcccctgctccaggacgcacctccgagacgcacagcggccctgggctgcctggtcaaggctactcccagagagta

SEQ ID NO: 443447 - DNA, 382 bp, Homo sapiens
  misc_feature: NA.19.85.H08.2.454.heavy.2.nb
tgccttagtcctggagtccaaggcacttccacttggtgatcagtactgaacacagaggactcaccatggagttggggttgtgcttgggttttccttgtcgctattttagcaggtgtccaatgtgaggtggagttggtggagtcgtgggggagcttggttcagccgtggagggtccctgagagtctcctgcacagcctctggattcaccttcagtaactatgagatggactggactccgccaggctccgaggaagggctggagtggattgcctatgtcactagtgagggcaagtcacgtcctacgcggactcgtgtcggcggggtccgtttaccatctccagagacaatcgaccaagaagacgctcttctgactaagttggac

SEQ ID NO: 443448 - DNA, 508 bp, Homo sapiens
  misc_feature: NA.19.86.H09.1.454.heavy.2.nb
gaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcaagtaaagtggttcgacccgtggggccagggaaccctggtcaccgtctcctcagcctccaccaacgggcccatccggtccttcccccgtggccgccctgcctccaggacgccacctccgaagacgcacacgccggccctgggctgcctggtcaaggctacttcccacgagagta

SEQ ID NO: 443449 - DNA, 450 bp, Homo sapiens
  misc_feature: NA.19.86.H09.2.454.heavy.2.nb
gaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaaggcaagtaaagtggttcgacccgtggggccagggaaccctggtcaccgtctcctcagcctccaccaacgggcccatccggtccttcccccgtggccgcccgttcgccttccgaggcgcc

SEQ ID NO: 443450 - DNA, 328 bp, Homo sapiens
  misc_feature: NA.19.86.H09.5.454.heavy.2.nb
cggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggccccatcggtcttccccctggccgccctgctccaggagcacctccgagagcacagccggccctgggctgcctggtcaggactacttcccacgagagta

SEQ ID NO: 443451 - DNA, 439 bp, Homo sapiens
  misc_feature: NA.21.19.B08.1.454.heavy.2.nb
  modified_base (407)..(407): a, c, t, g, unknown or other
tagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatccgccttcagtaccatagtatgaattggatccgccaggctccgaggaaagggctggagtggctctcacagtattagtggtagtagtagtttcatatttaacgcaagactcagtgcagggccattcaccatctccagagacaacgccaaagaacttccctgtatctgacaaatggacagcctgagagtcgaggacacggctatgtattacngtgcgggtgcgtgggggcgggatggacagcgt

SEQ ID NO: 443452 - DNA, 355 bp, Homo sapiens
  misc_feature: NA.21.19.B08.2.454.heavy.2.nb
attgggagtgtctataatacggggagtcaatatcgtggtgacactccctactacaacccgtcttttaagagtcgagtcactatatcagtgcgctcgtccacgaaccaggtctccctgaggatgagatctgtgacggccgcagacacggccaagtatttctgtgcgagagaccccggagttagcgacgcctggaggcactggtacttcgatgcctggggccgtggcgccctggtcactgtctcatcagcttccaccaagggcccatcggtcttccccctggcgccctgctcaggagcaacctctgggggcacagcggccctgggctgcctggtcaaggctacttcccgagcgacga

SEQ ID NO: 443453 - DNA, 373 bp, Homo sapiens
  misc_feature: NA.21.23.C01.1.454.heavy.2.nb
cctgggattcccagctgtttctgcttgctgatcaggactgcacacagagaactcaccatggagtttgggctgagctgggttttccttgttgctatttaaaaggtgtccagtgtgaggtgcagctggtggagtccgggggagcttagttcagccgtgggggtccctgagactctcctgtgcagcctctggattcaccttcagtagctactggatgcactgggtccgccaagctccgaggggagggctggttgggggtctcacgtattaatagtgagtgggagtacgcacaagctacgcggactccggtagaacgggccgattcaccatctccagacgacaacgccaaagaacacgctgtatctgacaaatgaac

SEQ ID NO: 443454 - DNA, 403 bp, Homo sapiens
  misc_feature: NA.21.27.C05.1.454.heavy.2.nb
  modified_base (394)..(394): a, c, t, g, unknown or other
gctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggtggaattggattaggcagtccccgtgagaggccttgagtggcttggaaggacctattatacgtcccagtggtatgaagactatgcagattctgtgagcggtcgtctcaccatcaccccagacacgtcaagaatcagtctccctaccacctaatgtctgtcactcccgacgacacggctagtttattttcgngtcaagagg

SEQ ID NO: 443455 - DNA, 389 bp, Homo sapiens
  misc_feature: NA.21.34.D01.1.454.heavy.2.nb
gtccagcctggggggtccctgagagtctcctgtgtggcctctggattcaagtttaatacctattggatgagctgggtccgccaggctccagggaaggggctggagtgggtggccaacataaaggaagatggaagtgacaaaaagtatgtggactctgtgaagggccgattcaccatcttcagagacaacgccaagaactcactttactgcaaatgaatagcctgagagtcgaaagacacggctgtgtattactgtgcgagagatagcgaggaggtggagcagctcgtcgatttgaaactacaagtgggacgtcgtggggacaaaggggccacggtcaccgtctcctcacgccctaccaccgaaacgggcccacgtccggtccttccccc

SEQ ID NO: 443456 - DNA, 717 bp, Homo sapiens
  misc_feature: NA.21.35.D02.1.454.heavy.2.nb
agcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgactttgccatgcacgtgggtccccagactccgaggcaaggggctagagtggctggcagttatcgctattccgatggaagcgatatgtactatggacccggtgaagggccattcaccatccctaccgaaagaacgactaaactttaaccccgaaaaggtaaaacccaccggtccgtttagggtttttacccacggtaacctaaaaagttacggaaacggtaccgaaaccggtacccgttaaagggaaaaaacgggtaaacggggaaacggggaacccgtaaaccgggtacgtttaaggttaaaactttaaacgttaaaccgttgggttacggaaccggtacggtaaaacgggttaacccttttaaagtttaaacgtttaggttaacgggttaccgaaaacggggttaacccttaaaggtttaccggaaaccgttaaccggggtacgggggaacccgtaaacgggggtaaaccccgttcgggtaacccgtaaccccggttcctacccc

SEQ ID NO: 443457 - DNA, 500 bp, Homo sapiens
  misc_feature: NA.21.35.D02.2.454.heavy.2.nb
agcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgactttgccatgcacgtgggtccccagactccgaggcaaggggctagagtggctggcagttatcgctattccgatggaagcgatatgtactatggacccggtgaagggccattcaccatctccagagacaattccaaagaacacgctgtttctgacaaatgagcagcctagaaagaagaggacacggctagtatataactgtagcgcgaggtaccttattattatggttcagggtaacctattgacttacgtcggggaccacgggaaccctggtccaccgtctcctcacg

SEQ ID NO: 443458 - DNA, 309 bp, Homo sapiens
  misc_feature: NA.21.37.D04.1.454.heavy.2.nb
agactgacggtccccccaggagttcaggtgctgggcacggtgggcatgtgtgagttttgtcacaagatttgggctcaactctcttgtccaccttgtgcagtctggggctgaggtgaagaagcctggggcctcagtgaaggtttcctgcgaggcttctggatacacctttactagttatgctatgctagttgggtgcgccaggcccccggagaagggcttgagtggatgggatggctccacgctggcaatggttaacacaaaatattcacagagttccaggcagagtccaccattaccaggacacatccg

SEQ ID NO: 443459 - DNA, 446 bp, Homo sapiens
  misc_feature: NA.21.4.A04.1.454.heavy.2.nb
gagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtcccccaggctccgaggggaaggggctgggagtggggtcggccgtatacgaaggaaagctaacagttacagtacagaatacggcgcgtctggtagaaagggaagttcaccatctcaaagagatgattcaaaagactcactgtatctagacaaatgaaacagacctagaaaacccgaggacacggccgtagtattatgtggtagacaaaag

SEQ ID NO: 443460 - DNA, 442 bp, Homo sapiens
  misc_feature: NA.21.40.D07.1.454.heavy.2.nb
aggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccaggccgtggggggtccctgagactctcctgtgcagcctctggattcacctttagtagctattggatgagctgggtccgccaggctccgaggggaaggggctgggagtgggtgccaacataaagccaagatggaagtgagacatactatgtggactctgtgaagggccattcacatctccagagacaacgccaagagctcactgtatctagacaaatgaacagcctagagagtcgaggacacggctgtgtattactgtgcgagacgactccccgtacggt

SEQ ID NO: 443461 - DNA, 499 bp, Homo sapiens
  misc_feature: NA.21.46.E02.1.454.heavy.2.nb
tggttctcggggctgccctttggttttggagatggttttctcgatgggggctgggaggcttagttcaaccgggggggtccctgagactctcttgtgcagcctctcgatttaacttcaatatttactggatgcactgggtccgccaagctccgagggaagggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtggggccagggaaccctggtaaccgtctcctcagcctccaccaagggcccatcggtccttccccctggccgccctgcctccaggacgcacctccgagagcacagcggccctgggctgcctggtcaaggctaccgttcccgaagcgacga

SEQ ID NO: 443462 - DNA, 339 bp, Homo sapiens
  misc_feature: NA.21.53.E09.1.454.heavy.2.nb
gagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggaggcttggtcaagcctgggagggtccctgagactctcctgtgcagcctctggattcaccttcagtgactactacagtgggctggactccgcaggctccgaggggagggctgggagtgggtctcatatattagtagtagtggtacgtcccgtatctacgcagactcgtgtaggaaacggggccc

SEQ ID NO: 443463 - DNA, 337 bp, Homo sapiens
  misc_feature: NA.21.60.F05.1.454.heavy.2.nb
tggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgatggttgaagttcgaccccgtgggggccgggacctggtcaccgtctcctcggcctccaccaagggcccatccggtcttccccctggccgccctgctccaggagcacctccgagagcacagcggccccctgggctgcctggtcaaggctactcccgagcgacga

SEQ ID NO: 443464 - DNA, 379 bp, Homo sapiens
  misc_feature: NA.21.61.F06.1.454.heavy.2.nb
ccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacacggcccctggacaaggacttgagtggatgggatggatcagcgcttacaatggttaacactaaactatgacacagaaactccgagggcagacgtcaccatcgaccacagacacactaccacgagacacagcctacatggaagctaggacggagcccgtagga

SEQ ID NO: 443465 - DNA, 465 bp, Homo sapiens
  misc_feature: NA.21.67.G01.1.454.heavy.2.nb
  modified_base (320)..(320): a, c, t, g, unknown or other
accacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaagatggagtatggtcaggtaatttcaggggcagaattaccttgaccacngactcatccacgggcacagcctacttggaactgaggaacctgagaatggacgacacggccacatattattgtgcgcgagtgggggcagttgtagactactactattattacttcttggacgtctggggcaaagggaccacggtca

SEQ ID NO: 443466 - DNA, 530 bp, Homo sapiens
  misc_feature: NA.21.70.G04.1.454.heavy.2.nb
gcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgcccctattacggtatggacgtctggggccaaggggaccgcagtcaccgtctcctcacgcctccaccaagggcccatccggtccttcccccgtggccgccctgcctccgaggacgccacctccgacgacgcacagcggccggcccgtgggcctcggcccgtggtaccaacggacctaccgttacccgagccgaacga

SEQ ID NO: 443467 - DNA, 371 bp, Homo sapiens
  misc_feature: NA.21.75.G09.2.454.heavy.2.nb
agccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagtatttggacagccgagggccggtccctgagactctcctgtacaacctctggattcacctttggtgattatgctatgagctggttcccgccaggcctccgaggggaagggctggagtgggttgtttcgtcagaagcaaagtattagtggtaggaacaccccgagattacgccgcgtctgtgaaagacagattcaacaatctacaagagatgattaccaaaagcatcg

SEQ ID NO: 443468 - DNA, 457 bp, Homo sapiens
  misc_feature: NA.21.76.G10.1.454.heavy.2.nb
cagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccgagggaaggggctggagtgggtctcgagtttatttatagtggtggtggtgcagattacgcagactccggtgaacgggccgattcaccatctccagagacaattccatgaacacgctgtatcttacaaatgaacagcctgagacgccgacgacacggccgtatatactgtgcgacgggagtgacggggaggagggcaagtggatacgttgaccgacgt

SEQ ID NO: 443469 - DNA, 334 bp, Homo sapiens
  misc_feature: NA.21.77.G11.1.454.heavy.2.nb
agcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggtccgccaggcctccgaggcgaagggggctgggagtgggtgcagttctatcatatgatggacttaataaatcctatgcgactcgtagaagggccattcaccatc

SEQ ID NO: 443470 - DNA, 478 bp, Homo sapiens
  misc_feature: NA.21.78.H01.1.454.heavy.2.nb
gagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcacttatttatagtggtggtaccccacatactacacagactccgtgaacgggccgattccaccatctacagaagacaattccaaggaacacattgtatcttacaaatgaaataacctgagacgccgaggacacggccatgtattactgtgtggggctagtttacttcgaccccgtgggggcccgggaaccctggtccaccggtcctcccca

SEQ ID NO: 443471 - DNA, 481 bp, Homo sapiens
  misc_feature: NA.21.78.H01.2.454.heavy.2.nb
gagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctctactttatttatagtggtggtaccccacatactacacagactccgtgaacgggccgattcaccatctacagaagacaattccaaggaacacattgtatcttacaaatgaaataacctgagagaccgaggacacggccatgtattactgtgtggggctagtttactcgaccccgtgggggacccggggaacccgtggtccaccggtcctcccca

SEQ ID NO: 443472 - DNA, 476 bp, Homo sapiens
  misc_feature: NA.21.78.H01.3.454.heavy.2.nb
gagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctttatttatagtggtggtaccccacatactacacagactccgtgaacgggccgattcaccatctacagaagacaattccaaggaacacattgtatcttacaaatgaaataacctgagacgaccgaggacacggccatgtattactgtgtggggctagtttactcgaccccgtgggggacccgggtaaccctggtccaccggtcctcccca

SEQ ID NO: 443473 - DNA, 376 bp, Homo sapiens
  misc_feature: NA.21.85.H08.1.454.heavy.2.nb
aggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagctgtggtacggccgtgggggtccctgagctctcctgtgaagcctctggattcacctttgatgattagtggcatggcctgggtccgccaagctccgaggggaaggggctgggagtgggtctcgtggtataaattacaagtggaggtcacacagcttatagagactctgtgaggggccgattcaccatctccagagacagcgaccaaagaactccctgtatct

SEQ ID NO: 443474 - DNA, 521 bp, Homo sapiens
  misc_feature: NA.21.86.H09.1.454.heavy.2.nb
aagactgacggtcctgcccgtactgggcctcccatggggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagaatcagttctcctgctatttgctactctgtgactcccgacgacacggctgtctactattgtgtaagacactcccacgacggggctccacactccgaccccgtcggggccgacgggaaccctacgtccaccgtcctcctcacgcctccaccgaacgggcccacgtcggtccttcccccgtcggcccgccctcgcctccgacggacgccacctccgagacgcacacgccggccctgggct

SEQ ID NO: 443475 - DNA, 446 bp, Homo sapiens
  misc_feature: NA.22.11.A11.1.454.heavy.2.nb
agcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccgccaggctccgaggggaaggggctgggagtggatctcgagttattatctcggtaggtaacacatactacgcagactccgtggagggccgattcaccatctccagagacaattaccaagaacacggtgtatcttacaaatgaacagcctagagagccgatgacacggccgtgtattactgtgtgagatacaaaacttccaaagccgcggggtacaccc

SEQ ID NO: 443476 - DNA, 315 bp, Homo sapiens
  misc_feature: NA.22.28.C06.2.454.heavy.2.nb
cttgaccaggcagctcccagatgggtcctgtcccaggtgcacctgcaggagtcgggcccaggactggtgaagccttcggagaccctgtccctcacctgcattgtctccggtgctccatcagtgattactactggacctggatccggcacgtccccagggcagggactggaatggattggatatttccatacgactgcgatgaccaactcgccaacccctcctcgagggctcgagtcagcctgtcagtagacacgtaccaagaaccagacttcccagacgactcgacccctctgtcgacccgccgacgacggaccg

SEQ ID NO: 443477 - DNA, 335 bp, Homo sapiens
  misc_feature: NA.22.29.C07.1.454.heavy.2.nb
gtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgactggggccagggaaccctggtcaccgtctcctcagcctccaccaagggcccatccggtcttccccctggccgccctgcctccaggacgccaccctccgagacgcacagcggccctgggctgcctggtcaaggctacttccacgcgtatgt

SEQ ID NO: 443478 - DNA, 590 bp, Homo sapiens
  misc_feature: NA.22.36.D03.1.454.heavy.2.nb
gagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggtccgccaggctccgaggggaaggggttgcagtgggtctcggggattggaagtgatggtgccacacactacgcagactccgtgaggggccgcttcatcatctccagagacgattaccgaaaacacagtgaatctgcaaatgtacagcctcagcgccgaggacacggccgtctacttctgtgcgaaagacctcttattttcgggccgcggccgacctacgtcggggccagggccacccgtggtccaccgtctcttcagcctccaccgaacgggcccatccggtccttcccccgtggccgcccctgcctccaggacgccaccctccgagacgcacgacgccggccctgggcct

SEQ ID NO: 443479 - DNA, 490 bp, Homo sapiens
  misc_feature: NA.22.38.D05.1.454.heavy.2.nb
tcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgcacttatttatggatgacggttaccgctacagtccatctctgaggaggagactcaccatccaccaagaccaacccccaaaaccacggtacggtccttaacaatcgaccaccatcggaccctgtggacacagccacatatttctgtgcacactctagtaggagcaccgtggtagtctgaccaaactcggttaccgaccccgtgggggccccggaacccttgggtccaccgtctcctcacgccctccgaccaacgggcccatccggtcc

SEQ ID NO: 443480 - DNA, 494 bp, Homo sapiens
  misc_feature: NA.22.38.D05.2.454.heavy.2.nb
tcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgcacttatttatggatgacggttaccgctacagtccatctctgaggaggagactcaccatccaccaagacccaacccccaaaaccgaacggtacggtccttaacaatcgaccaccatcggaccctgtggacacagccacatatttctgtgcacactctagtaggagcaccgtggtagtctgaccaaacgtcggttaccgaccccgtgggggccccggaaccctgggtccaccggtctcctcacgccctccgaccaacgggcccatccggtcc

SEQ ID NO: 443481 - DNA, 497 bp, Homo sapiens
  misc_feature: NA.22.38.D05.3.454.heavy.2.nb
tcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgcacttatttatggatgacggttaccgctacagtccatctctgaggaggagactcaccatccaccaacgaccaacccccaaaaaccgacggtacggtccttaacaatcgaccaccatcggaccctgtggacacagccacatatttctgtgcacactctagtaggagcaccgtggtagtctgaccaaacgtcggttaccgaccccgtgggggccccgggaacccttgggtccacccggtctcctcacgccctccgaccaacgggcccatccggtcc

SEQ ID NO: 443482 - DNA, 493 bp, Homo sapiens
  misc_feature: NA.22.38.D05.4.454.heavy.2.nb
tcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgcacttatttatggatgacggttaccgctacagtccatctctgaggaggagactcaccatccaccaacgacccaacccccaaaaccaacggtacggtccttaacaatcgaccaccatcggaccctgtggacacagccacatatttctgtgcacactctagtaggagcaccgtggtagtctgaccaaactcggttaccgaccccgtgggggccccggaaccctgggtccaccggtctcctcacgccctccgaccaacgggcccatccggtcc

SEQ ID NO: 443483 - DNA, 411 bp, Homo sapiens
  misc_feature: NA.22.41.D08.1.454.heavy.2.nb
  modified_base (315)..(315): a, c, t, g, unknown or other
accacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacaggcccctggacaacggcctgagtggatgggatggatgaacccttgtaaagggaaacacaaactatgcagagaggcctccgagggcagagtcaccntgaccgcagacacaccaaacgaccacagcctacatggagttgaggagtctgagacctgacgacacggccgtatattactgcgcgagagggcgtttc

SEQ ID NO: 443484 - DNA, 328 bp, Homo sapiens
  misc_feature: NA.22.46.E02.2.454.heavy.2.nb
atttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccaccaaggcccatccggtcttcccctggccgccctgctccaggacgcacctccgagacgcacagcggccccctggggcctcgcctggtcaaggctacttccacgcgtatgt

SEQ ID NO: 443485 - DNA, 451 bp, Homo sapiens
  misc_feature: NA.22.69.G03.1.454.heavy.2.nb
ggtacagcctggggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaagggccgttcaccctctccagagacaattccaagaatacggtgtatctgcaaatgaacagcctgagagccgaggacacggccgtatattactgtgcgaatcaaaagttcggggactccgattcgatatggacgtcgtggggccaagggaccacggtcaccgtctcctcagccctccaccaacgggccccatccggtccttcccccgtggccgccctgcctccgaggacgcacctccgagacgcacagcggccctgggcctgcctggtcaaggctacttccacgcgtactg

SEQ ID NO: 443486 - DNA, 340 bp, Homo sapiens
  misc_feature: NA.22.80.H03.1.454.heavy.2.nb
ggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgatttttggagtggttattccccctctgactactggggccagggaaccctggtcaccgtctcctcagcctccaccaaggcccatcggtcttccccctggcaccctcctccaagagcacctctgggggcacacgcggccctggggctgcctggtcaaggactacttccacgcgtatgt

SEQ ID NO: 443487 - DNA, 447 bp, Homo sapiens
  misc_feature: NA.22.82.H05.1.454.heavy.2.nb
agcccagccctgggattttcaggtgttttcatttggtgatcaggactgaacagagagaactcaccatggagtttgggctgagctggtctttttcttgtggctaattttaaaacgtgtccagtgtgaggtgcagctggcggagtcgtgggggaggcctggtacgaggccggggggtccctgagactctcctgtgtagcctccggattcaccttagcagacatggcatgagcgtgggtccgccaggctccgaggggaaggggccggaggtgggtgtcgagtattagtagtagtggtgatagaatttaccacacagctccgtgaacgggccgcttcaccatctctagagacaattcccaagaaccacactgtatctagacaaatgactaggctagagagccgacgacacggcctatttatactgcgacgaaaggatacgtacggggtcga

SEQ ID NO: 443488 - DNA, 706 bp, Homo sapiens
  misc_feature: NA.22.85.H08.1.454.heavy.2.nb
cacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccggagatcatgagggtgtccgttggggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctcgggtccgccaggctccgaggggaagggcctggagtggatctcacttatttatagtggtggtaccacatactacacagctccgtgaagggccgattcaccatctcagaagacaattccaggaacacattgtatcttacaaatgaaataacctgagagccgaggacacggccatgtattactgtgtgggctatttactcgaccccgtggggcccgggaacctggtccaccgtcctccccaccctccaccaacggcccatctcgtccttccccccggccaccctcctccaagcgccacctcgt

SEQ ID NO: 443489 - DNA, 325 bp, Homo sapiens
  misc_feature: NA.22.85.H08.2.454.heavy.2.nb
agggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccgtggggccggggaaccctggtcaccgtctccccaccctccaccaaggcccatcgtccttccccctggccaccctcctccaagacgcacctcgtgggggcacagcggccctgggctgcctggtcaaggactacttccacgcgtatgt

SEQ ID NO: 443490 - DNA, 571 bp, Homo sapiens
  misc_feature: NA.22.86.H09.1.454.heavy.2.nb
gaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtggactcgtgaagggccgattcaccatctccagagacaactccaaagaacactctgtttctaccaaatgaacagcctgagaggcgaggacacggcagtgtattactgtgcgagagatcgacatgaacgtaacggggaaatcgttttagatctcgtggggaccaaggggacacgtggtcaccgtctcttcacgcctccaccgaacgggcccatccggtccttcccccgtggccgccctgctccaggacg

SEQ ID NO: 443491 - DNA, 308 bp, Homo sapiens
  misc_feature: NA.25.16.B05.1.454.heavy.2.nb
gccatgcactgggtccggcaagctccagggaagggcctggagtgggtctcaggtattagttggaatagtggtagcataggctatgcggactctgtgaagggccgattcaccatctccagagacaacgccaagaactccctgtatctgacaaatgaacagtctgagagctgaggacacggccttgtattactgtagactaaaaattattacgttagcagcagctacggtaaaggttccttactactactactactacatggacgtcgtggggacaaagggaccacggtcccaccgtctcctcacgccct

SEQ ID NO: 443492 - DNA, 343 bp, Homo sapiens
  misc_feature: NA.25.2.A02.2.454.heavy.2.nb
gccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggagcttggtccagcctgggagggtccgtgagagtctcctgtgcagcctctggattcatcttcagtgaccactacatggactgggtccgccaggctccgaggggagggctgggagtgggtgcgtatagaaataagctaagagtacacacagatacgccgcgtctgtgaaaggcagattcattatctacaaagagatg

SEQ ID NO: 443493 - DNA, 254 bp, Homo sapiens
  misc_feature: NA.25.21.B10.1.454.heavy.2.nb
ctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactccgcaggcgtccggggaaggtctgcagtgg

SEQ ID NO: 443494 - DNA, 369 bp, Homo sapiens
  misc_feature: NA.25.22.B11.2.454.heavy.2.nb
agccccagccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctggagggtccctgagactctcctgtgaagtctctggattcaccatcaatgactactttatggcctggatccgcaggctccgaggggagggctggagtggatttcatttatcagtaatggagtaatggactatttaaatccagactcgtccggaggggcccgcttcaccatctccgagggaccaacggccaacaatacaacttctt

SEQ ID NO: 443495 - DNA, 579 bp, Homo sapiens
  misc_feature: NA.25.23.C01.1.454.heavy.2.nb
ctttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtggctccgtcagtgcttattactggagctggactccgccagtccggccgggaggggactggagtggattgggctatatatacgaatggattaaccacctacaacccctccctcaagagtcgagtcaccatatcagcggacacgtccagggatcaggtgttcctgcatctgacttctgcgactgccgcggacacggccctatactactgtgccagagattcggactgcgacgatttttcggagaatttattatctttgtgcttttgacatgtggggcaaagggaccacggtcaccgtctctcagcctccaccaagggcccatcggtcttccccctggcaccctcctccaagagcacctctgggggcacagcggccctgggctgcctggtcaaggctacttccactgtacagt

SEQ ID NO: 443496 - DNA, 281 bp, Homo sapiens
  misc_feature: NA.25.25.C03.1.454.heavy.2.nb
  modified_base (209)..(209): a, c, t, g, unknown or other
gtccagcctgggaggtccctgagactctcctgttcagcctctgggttcatgttcagttcctctactatacactgggtccgccacgccccccggcaaggggctggagtgggtggctcttatctcatatgatggaaatgttaaatactacgccgactccgtgaagggccgattcgccgtctccagagacaactccaagaacacggtgttcngcaactgaacggctgagaaatgtggacacggctgtatattactgtgcgcgtatttctctccctcgctcgccc

SEQ ID NO: 443497 - DNA, 426 bp, Homo sapiens
  misc_feature: NA.25.28.C06.3.454.heavy.2.nb
ggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaaagagaaccctctatctgcaaatgaaacaacttgagagtccgaggatacggccgtttatactgtgcgactcaggagtggctaggaaaagtcgtagtctcattcccgtcgacctcgtggggccagggcacccgtggtccaccgtctcctcacgccttccaccaacgggccca

SEQ ID NO: 443498 - DNA, 370 bp, Homo sapiens
  misc_feature: NA.25.28.C06.4.454.heavy.2.nb
gttttcctcgttgctcttttaagaggtgtccagtgtcaggtgcagctggtgcagtctgggggagcgtggtccaccctgggaggtccctgagactctcctgtgcagcctctggattcatcttcaacacctatgcaatgcactgggtccccaggctccaggcaaggggctggagtgggtggcagttattcatatgatggaactaaataaaagtatgttgactccgtggcggccgattcaccgtctccagagacagatccaaagaagacggtgtactcctaccaaatcaaacaacctgagatccgaggacacggctgtgtattactgtgcgagagacgtcgggcggcgagggtccgtacccccgagggaacgt

SEQ ID NO: 443499 - DNA, 341 bp, Homo sapiens
  misc_feature: NA.25.30.C08.1.454.heavy.2.nb
gctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtgacctctggggccagggcaccctggtcaccgtctcctcagcctccaccaagggcccatcggtctccccctggccgcccctgctccaggacgcacctccgagagcacagcggccctgggcctgcctggtcaaggcctacttccactgtac

SEQ ID NO: 443500 - DNA, 326 bp, Homo sapiens
  misc_feature: NA.25.30.C08.2.454.heavy.2.nb
gttggccgtattaagaccaatagtgaaggtgggacaagagactacgctgcatccgtgaaagacagattcaccatctcaagggatgattcaaagaccacgctgtatctgcagatgaacagcctgaaggtagaggacacagccgtttattactgtacctcctttgaaagcaactcgggggactactggggccagggcaccctggtcaccgtctcctcagcctccaccaagggcccatcggtctccccctggccgcccctgctccaggacgcacctccgagagcacagcggccctgggcctgcctggtcaaggcctacttccactgtac

SEQ ID NO: 443501 - DNA, 320 bp, Homo sapiens
  misc_feature: NA.25.34.D01.4.454.heavy.2.nb
gtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatatttgactggttattagtggggggcctactactactactacatggacgtcgtggggcaaagggaccacggtcaccgtctcctcagcctccaccgaacgggcccatccggtccttccccctggcccacccctcctccaagagcacctctcgggggcacgagccggccctggg

SEQ ID NO: 443502 - DNA, 458 bp, Homo sapiens
  misc_feature: NA.25.36.D03.3.454.heavy.2.nb
cctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggcgtatatatacgaatggattaaccacctacaacccctcctcaagagtcgagtcaccatatcagcggacacgtccagggatcgaggtgttcctgcatctgacttctgcgactgccgccggacacggccctatacctactgtcgccagagattcgggactgcgacgtattttcggagtaattattatctttgtgtcttttgactatggtggggccaaggggacgacggtcaccgtctcttcacgcctccaccaacgggcccaatcggttcttcccccttggccacccttccttccagaagcaacctc

SEQ ID NO: 443503 - DNA, 391 bp, Homo sapiens
  misc_feature: NA.25.36.D03.6.454.heavy.2.nb
aaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacacggcccctggacaaggggcttggagtggatggcagtggatcagccttaaacatcggtatcacagactatgcacaggaattccgagggcagagtcacttgaccacagacacatccacgagacacagcctacatggacctgagacgcctagagatctgacgacacggccgtat

SEQ ID NO: 443504 - DNA, 366 bp, Homo sapiens
  misc_feature: NA.25.36.D03.8.454.heavy.2.nb
gagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggaggcttggtccagcctgggagggtccgtgagagtctcctgtgcagcctctggattcatcttcagtgaccatacatggactggggtcccgccagggcctcccgaggggaaggggctggggaggtgggtgcccgtatagaaataagctaagagttacaccacagaatacgccgcgtctgtagaaaggcagtattcattatctacaagaga

SEQ ID NO: 443505 - DNA, 428 bp, Homo sapiens
  misc_feature: NA.25.38.D05.1.454.heavy.2.nb
  modified_base (242)..(242): a, c, t, g, unknown or other
gagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaagtccctgagactctcctgtgcaacatctggattcgccttcagtaacttggcatccacgtgggtccnccaggctccaggcaagggctagagtgggtgacttttagtgggcatgatggcagtgaataaagcctatgcagactccgtcaagggccgcttctccatctccagagacaaacgccaaagaagacggtacctttagacaaatagaaaagcctagacgacccgagacacggctatgtatactgtagcgag

SEQ ID NO: 443506 - DNA, 379 bp, Homo sapiens
  misc_feature: NA.25.39.D06.3.454.heavy.2.nb
gagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggagcttggtccagccgtgggagggtccgtgagagtctcctgtgcagcctctggattcatcttcagtcgaccactacatggactgggtccccaggctccgagggagggctggagtgggtgcgtatagaaataagctaagagttacacacagaatacgccgcgtctgtagaaaggcagattcattatctacaagagattgaattacaaaggtaactcaactgtat

SEQ ID NO: 443507 - DNA, 456 bp, Homo sapiens
  misc_feature: NA.25.4.A04.2.454.heavy.2.nb
agccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagccttccggactcacctttggtgagcatgctatgacctgggtccgccaggctccgaggggaagggtctggagtggcttgggttcagttagaagcgaagcctagtgggtggggcaaacacaatacgccgcgtctagtaaaaggcagattcagcctctcaagagatgattaccaaaagcaatcgcctatctgcacatgagcagcctgagaagcgaggactcgagccgtgtacttactgttcttaattactctgacgtagttagttt

SEQ ID NO: 443508 - DNA, 300 bp, Homo sapiens
  misc_feature: NA.25.41.D08.1.454.heavy.2.nb
ggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactacgtggggccagggaaccctggtcaccgtctcctcagcctccaccaagggccccatccggtcttccccctggcgccctgctcccgaggacgccaccgtccgagacgcacacgccg

SEQ ID NO: 443509 - DNA, 335 bp, Homo sapiens
  misc_feature: NA.25.46.E02.2.454.heavy.2.nb
ctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtcgacctctgggccagggcaccctggtcaccgtctcctcagcttccaccaaggcccatcggtctcccctggcgccctgctccaggagcacctctggggccacagcgccctgggctgcctggtcaaggctacttccactgtacagt

SEQ ID NO: 443510 - DNA, 370 bp, Homo sapiens
  misc_feature: NA.25.51.E07.1.454.heavy.2.nb
agaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggagcttggtgcaggccgggagggtccctgagactctcctgtacagcgtctggatttgccttggcagccatgccctgggctgggtcccgcagggtccaggggaggcctgggagtgggtctcaaatgtgactccgtggcggtagtgtcacactctacgcggactcgtgtgaacggcccgcttcacaatactaccagagacaacttaccaaggtactaccc

SEQ ID NO: 443511 - DNA, 287 bp, Homo sapiens
  misc_feature: NA.25.53.E09.2.454.heavy.2.nb
tccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaaggccattcaccatctccagagacaattcccggaacattgtgtacttggaaatggtcagcctgagagtcgaggactcggctctgtattactgtgcgagatcggggaggtggtagtagttataccgggg

SEQ ID NO: 443512 - DNA, 357 bp, Homo sapiens
  misc_feature: NA.25.61.F06.1.454.heavy.2.nb
gtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatattttgactggttattatggggggcctactactactactacatggacgtctggggcaaagggaccacggtcaccgtctcctcagcctccaccaaggcccatcggtcttccccctggcaccctcctccaagacgcacctctgggggcacagcggccctgggctgcctggtcaaggctacttccactgtacagt

SEQ ID NO: 443513 - DNA, 313 bp, Homo sapiens
  misc_feature: NA.25.61.F06.2.454.heavy.2.nb
attggccatatattttacagtgggagtaccaattacaatccctccctcaagagtcgcgtcaccatatcagtagagaggtccaagaataagttctcccttaagttgagctctgtgaccgctgcggacacggccgtgtattactgtgcggagggggctttgacgtatttttggggtgttattactaccccttaattcctctctttgacctgtggggccagggaaccctggtcaccgtctcctcacgccctccaccaacgggccccatccggtccttccccctggccgccctgcctccaggacgccacctccgaga

SEQ ID NO: 443514 - DNA, 189 bp, Homo sapiens
  misc_feature: NA.25.61.F06.3.454.heavy.2.nb
ttggccgtattagaaataaagctaagagttacaccacagaatacgccgcgtctgtgaaaggcagattcattatctcaagagatgattcaaagaactcactgtatctgcaaatgaacagcctgaaaaccgagacacggccgtgtattactgtgctaggtcagactacggtgactctaacccctattactc

SEQ ID NO: 443515 - DNA, 316 bp, Homo sapiens
  misc_feature: NA.25.70.G04.2.454.heavy.2.nb
  modified_base (251)..(251): a, c, t, g, unknown or other
gtctcacgtcttaataatgatggcagtaccacaaattacgcggactccgtgaagggccgattcaccatttccagagacaacgccaagaacacggtgtatctgcaaatgagtagtctgagagccgaggacacggctgtctattactgtgcaagaggaggcatagcagcagctggctttgactgctggggccagggaccctggtcaccgtctcctcagcctccaccaaggcccatccggtctccccctggccncccctgcctccaggacgccaccctcgagacgcccacgccggccctggggcctgccctggtccaaa

SEQ ID NO: 443516 - DNA, 407 bp, Homo sapiens
  misc_feature: NA.25.71.G05.1.454.heavy.2.nb
tggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgccaggctccggggaaggtctgcagtggatttcatccattagtggtcttaagcgtagactaaattttagcagactcggtagacggccgttcaccatcctccagacgacaacgccgacgtactttctctttctgacaaatgaacagcctcagacgccgagacacggctgtttattctgtgcgag

SEQ ID NO: 443517 - DNA, 396 bp, Homo sapiens
  misc_feature: NA.25.75.G09.1.454.heavy.2.nb
tccctcctcagaagcccccagagcacaactcctcaccatggactggacctggaggatcctcttttggtggcagcagccacaggtgcccactcccaggtccagcttgtgcagtctggggctgaggtgaagaagcctggggcctcagtgaaggtttcctgcaaggcttctggatacaccttcgcaagtcatgctcttcattgggtgcgccaggcccccggaaagggcttgagtggatgggatggatcaacactgccaatggtaaatgcaaactatcgcccagaaactcccagggcagagtcacgtttacagggacacatccgagagtacaggctacatggacctgagtggcctggtatcgtgaagacacgggctatgtattactgtgtgagatacgag

SEQ ID NO: 443518 - DNA, 408 bp, Homo sapiens
  misc_feature: NA.25.76.G10.1.454.heavy.2.nb
gccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagcctgggggtccctgagactctcctgtgtagcctccggattcagcttcagcaaatatagtgtgaacgtgggtccgccaggctccgaggggaaggggctgggagtgggtcgcagttcgtgagtagtagtagtacttaataaatactacgcagagtcagtggaggccgattcactatctcagaacaacaccaagagctattttgttctgacaaatgaaacagcctgagagaccgaggatacggctctgtattattg

SEQ ID NO: 443519 - DNA, 333 bp, Homo sapiens
  misc_feature: NA.25.77.G11.1.454.heavy.2.nb
  modified_base (331)..(331): a, c, t, g, unknown or other
gattgggagtgtttattatacaggggccacttggcgttacccgcccctcaggagtcgcgtttcgatgtccgttgacacggccacgaatcacttcaccctgaccctaacgtctgtgaccgccgcagacgcggccatatactattgtggggcgagtctgccgtcatacagtagtggccagttcgacctgtcggggcccggaaccctggtcgccgtctcatcggcctccaccaagggcccatcggtcttccccctggcaccctcctccaagacgcacctctcgggggcacagcggccctgggctgcctggtccaaggactacgtccactgtacngt

SEQ ID NO: 443520 - DNA, 324 bp, Homo sapiens
  misc_feature: NA.25.79.H02.1.454.heavy.2.nb
attgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactggggccagggaaccctggtaaccgtctcctcaccttccaccaagggcccatcggtcttccccctggcgccctgctccaggagcacctctgggggcacagcggccctgggctgcctggtcaaggacctacttccactgtacagt

SEQ ID NO: 443521 - DNA, 414 bp, Homo sapiens
  misc_feature: NA.25.82.H05.1.454.heavy.2.nb
gacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcgacccggggggtcctgagactctcctgtgtgggatctggagtcgccgtgactaaatattggatgcacgtgggccgcgaggcgccgaggggagggctggagtgggtctcacgtattcatcgtgagtcgggaccaccacaacttacgcggacctccgtgaagggccgattcacatctccagagacatcgccaacgacaccctctacttgacaaatgaacagtcttagagtcgaggacacggctgtctattactgtgcgatggcggctacta

SEQ ID NO: 443522 - DNA, 472 bp, Homo sapiens
  misc_feature: NA.25.85.H08.1.454.heavy.2.nb
acacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgccaggctccgggggaagggactgggagtgggtctcagtcatttaaccgatggtcggagatactacacagagtccgtgaagggccgattcatcatgtccagagacagttccacgaacacatttctttctcatatgaacagcccctgagtgccgaggacacggccatatattatgtgcgagagtgagtggggcctactccttcattctcattactacatggacgtcgtggggctcgagggaccacggtcaccgtctcctcacgcttccaccaacgggcccatccggtccttcccccgtggccgcccgtcgcctccgacggacgccaccgtc

SEQ ID NO: 443523 - DNA, 378 bp, Homo sapiens
  misc_feature: NA.25.86.H09.2.454.heavy.2.nb
gaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccggggggtccctgagactctcctgtgtagcctctggattcatgttgatgattatgccatgcacgtgggtccgtcgaagggtccggggaagggtcgtgggaggtgggtctctcttatgacgttggggatggggagaagaacctactatgcagactctgtgaagggtcattcaccacctccagagacaacatacaaagaacctccctagta

SEQ ID NO: 443524 - DNA, 383 bp, Homo sapiens
  misc_feature: NA.25.87.H10.1.454.heavy.2.nb
cttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtactccatcaccagtaatgctcattactggggctggctccgccagcccccagggacggcctggagtggattgcgattgtctttcatagtgggatgcctactacagtcccctcccctcaagagtcgagtcacctatttcggtcgacacgtccacgcagcagttgtctctgacactgacgtctgtcacggccgccgacacggccgtctattactgtgcgagagtcagcgg

SEQ ID NO: 443525 - DNA, 340 bp, Homo sapiens
  misc_feature: NA.29.26.C04.1.454.heavy.2.nb
accacacccctccttgggagaatcccctagatcacagctcctcaccatggactggacctggagcatccttttcttggtggcagcagcaacaggtgtccactcccaggttcagctggtgcagtctggagctgaggtgaagaggcctggggcctcagtgaaggtctcctgcaaggcttctggttacagtctttaccacttatagtatctcgtgggtgcgacacggcccctggacaagggcttgagtggagtggggagatcaacacttacagacggaaacacaaactatgcacagagttccagggcagagtcaccatcgaccagacgacacaccaacgaacac

SEQ ID NO: 443526 - DNA, 342 bp, Homo sapiens
  misc_feature: NA.2.15.B04.1.454.heavy.2.nb
cccagccctgagattcccaggtgtttccattcggtgatcagcactgaacacagagaacgcaccatggagtttggactgaactgggttttccttgttgctattttaaaaggtgtccagtgtgaggtgcagctggtggagtcgtgggggaggcttggtacagccgtggggggtccctgcgactctcctgtgcagcctctggattcacctttgatgattataacattcactgggtcctcaagcgtccggggaaggtctggagtggtctctgttattacgttgggatggagcaactaccatactatgcaagactcgtgtgcaggggccattcaccacctccaagac

SEQ ID NO: 443527 - DNA, 337 bp, Homo sapiens
  misc_feature: NA.2.30.C08.1.454.heavy.2.nb
gtctcaagtattagtggtagtggcgttagcatgtactacgcagactccgtgaagggccggttcaccatatccagagacacttccaagaacacgctgcatctgcaaatgaacagtctgagagccgaggacacggccgtgtattactgtgcgaaagaatgggggacaggcgaagaataggcgatgcttttgacttctggggccaagggacaaaggtcaccgtctcttcagcctccaccaagggcccatcggtcttccccctggcaccctcctccaagagcacctctgggggcaccagcggccctgggctgcctggtcaaggctacttcctgtcgagcgt

SEQ ID NO: 443528 - DNA, 504 bp, Homo sapiens
  misc_feature: NA.2.33.C11.1.454.heavy.2.nb
ccttgggattcccaagtgttttcattcagtgatcaggactgaacacagaggactcaccatggactttgggctgaggtggattttccttgctgccattttaaaaggtttccactgtgagctgcgactggtggcgtcgtgggggaggcttggtgcaggccgggtgggtccctgcgactctcctgtgcaatttctgaagccccttccaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactctgtttctgcaaatgaacagcctggaagacgcggacacagccatgtattattgtacattaggacatatagtccctggggccaagggaaccctcgtcaccgtctcctcacgccctccaccaacgggcccatccggtccttcccccgtgg

SEQ ID NO: 443529 - DNA, 388 bp, Homo sapiens
  misc_feature: NA.2.4.A04.1.454.heavy.2.nb
tggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtcctccatcagcagtagtagttattacgtggggctggattcgccagcccccgagggaagggctggagtggagttggggagtttctattagtgggtaggggaacctacgtacaacccgtccctcaagagtcgacgtcaccgtatccttagacacgtccaagaaccaattctccctagaaactgaactctatgaccgcgcagacacggctgttactattgtacggcgtgtaacgtt

SEQ ID NO: 443530 - DNA, 241 bp, Homo sapiens
  misc_feature: NA.2.41.D08.1.454.heavy.2.nb
tgttgcaactattactactaatgggggtagtacatattatgcaaactctgtaaagggcagattcaccatctccagagacaattccaagaacaccttatatcttcaaatgggcagcctgagagttgaggacatggctgtgtattactgtgcgagagatggggtatattgtggtggtgattgtcttttattcgaagaagaggaaacgttgggggccgactattataactacgctatggacgtc

SEQ ID NO: 443531 - DNA, 245 bp, Homo sapiens
  misc_feature: NA.2.46.E02.1.454.heavy.2.nb
attggggaaatcaatcattttcgaggcaccacttacaacccgtccctcaagagtcgagtcaccattgcagtggacaggtccaagaaccagttttccctgaacttgaactctgtgaccgccgcggacacggctgtgtattactgtgcgagaggcgaattacccggtatgcgacacaccaagatcagctggtccgaaggctacttcgttactacggcatggacgtctggggccaagggaccacggtc

SEQ ID NO: 443532 - DNA, 319 bp, Homo sapiens
  misc_feature: NA.2.49.E05.2.454.heavy.2.nb
gccctgggattcccagctgtttctgcttgctgatcaggactgcacacagagaactcaccatggagtttgggctgagctgggttttccttgttgctattttaaaaggtgtccagtgcgaggtgctgctggtggagtccggggagcttagttcagccgtgggggtccctgagactctcctgtgcagcctctggattcaccttcagtcgctactggatgcactggttccgccaagttccgagggaagggctggagtgggtctcgacgcattgatccatccgtagggaataggattaacgacgcggcctccggtggacggggg

SEQ ID NO: 443533 - DNA, 357 bp, Homo sapiens
  misc_feature: NA.2.53.E09.1.454.heavy.2.nb
tcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttaacaacggtaacacaaactatgcacagaagttccagggcagagtcacctgaccacagcacatccacgagcacagtacaacctggacctgaggagcctgacatctgacgacacggccgtgtattat

SEQ ID NO: 443534 - DNA, 337 bp, Homo sapiens
  misc_feature: NA.2.55.E11.1.454.heavy.2.nb
aggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggaggcttcgtaaatccgtgggggtcccttggactctcctgtgcaggccctgaattcactctcaataatgcctacataaactggtccgccaggctccgaggggaagggcgtggagtgggttggccatataaaagcaaatcgatggtggacaatacactacgctgcaccgtgaaacggcagattcac

SEQ ID NO: 443535 - DNA, 310 bp, Homo sapiens
  misc_feature: NA.2.85.H08.1.454.heavy.2.nb
agctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaaggcttgagtggcgtggggggatcgatccctatgtttggtgaagcaaattacgcacagaagttccggggaagagtctcgattacccgcgacgaatccacgaacacagcctacat

SEQ ID NO: 443536 - DNA, 317 bp, Homo sapiens
  misc_feature: NA.2.86.H09.1.454.heavy.2.nb
acgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgattgactccgtgggccagggaccctggtcaccgtctcctcacgcctccaccaaggcccatcggtccttccccctggccgccctgctccaggagcacctccgagagcacagcggccctgggctcgcctggtcaaggctcttcctgtcgagcgt

SEQ ID NO: 443537 - DNA, 421 bp, Homo sapiens
  misc_feature: NA.38.2.A02.1.454.heavy.2.nb
tccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttctccctgaagttgacctctgtgaccgccgcagacacggccgtatattactgtgcgagagataaagtggttattactacaatgttccctactactttgactactggggccagggaccctggtcaccgtctcctcagcctccaccaagggccatcggtctcccctgcaccctcctccaagagcacctctgggggcacagcggccctgggctgcctggtcaaggactacttccacgtgatcga

SEQ ID NO: 443538 - DNA, 461 bp, Homo sapiens
  misc_feature: NA.38.23.C01.1.454.heavy.2.nb
agaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatattagtaatcattggatgagttgggtcccgccaggctccaggggacggggctgggagtggggtggccactaataaaccacgatggaactagaaaaaagctatgtggactctgtgaagggccgattcaccgtctccagagacaacgccaagaattcactgtatttgcaaatgaacagcctagagagtcgaaagacacggccatatattatgtagtaaaagatacattcgataagtggtgcgacgtacgggtg

SEQ ID NO: 443539 - DNA, 427 bp, Homo sapiens
  misc_feature: NA.38.25.C03.1.454.heavy.2.nb
accacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaaagtatcgacacataaatttccaagggcagagtcatcatgaccacagacacatccacgagcactgcctacatggaactgagaacctgagatctgacgacacggccttatattatgtgcgagacgactaaattcctacttacataatacg

SEQ ID NO: 443540 - DNA, 475 bp, Homo sapiens
  misc_feature: NA.38.26.C04.1.454.heavy.2.nb
ttcttcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgattatcgtgggggccaaaggggacaagtggtcaccgtctcctcagcctccaccaagggcccatccggtccttccccctcggccaccctcctccaagacgccacctcgtcgggggccaccgacgccggcccgtcgggctgccttggtcaaggactacttccacgtgaatcga

SEQ ID NO: 443541 - DNA, 477 bp, Homo sapiens
  misc_feature: NA.38.26.C04.2.454.heavy.2.nb
ttcttcgatgggggctgggagggctttgttggagaccttgcacttgtactccttgccattcagccagtcctggtgcaggacggtgaggacgctgaccacacggtacgtgctgttgtactgctcctcccgatctttggcaaaccacactacgcacacaagttccaggacagactcacgattaccgcggacgaatccacgagcacagtctacatggagatgagtagcctgagatctgacgacacggccgtgtatttctgtgcgagagagggggccaggggctcggtggtaacgttaggtgcttttgattatcgtgggggccaaaggggacaagtggtcaccgtctcctcagcctccaccaagggcccatccggtccttccccctcggccaccctcctccaagacgccacctcgtcgggggccaccgacgccggcccgtcgggctgccttggtcaaggactacttccgacgttgaatcga

SEQ ID NO: 443542 - DNA, 444 bp, Homo sapiens
  misc_feature: NA.38.26.C04.3.454.heavy.2.nb
acaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatactttcagctgggtgcgacaggcccctggacaagggcttgagtggatgggagggatcctccgatcgtttggacaaaccacacctacgcacacaagttccaggcagactcacgattaccgcgacgaatccacgagcacagtctacatggagatgagtagcctgagatctgacgacacggccgtgtatttctgtgcgagaggaggggccgaggggctcgggttggtaacgttaaggtgtcgttt

SEQ ID NO: 443543 - DNA, 585 bp, Homo sapiens
  misc_feature: NA.38.28.C06.1.454.heavy.2.nb
gagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtgattcacatattacgcagactccggtgggggccgttcaccatcaccagagacaactccaggagcacactatatctaacaaatgcacagcctgagagtcgaggacacggccgtgtattatgtgcgagagatcccaaaggtgacccaccttggtgtcttttgatttctgtggccaaaggggacaagtggtcaccgtctcttcagcctccaccaagggcccatccggtcttccccctggccgccctgctccaggacgcacctccgagacgcacagccggccctggggctgcc

SEQ ID NO: 443544 - DNA, 587 bp, Homo sapiens
  misc_feature: NA.38.28.C06.2.454.heavy.2.nb
gaagactgacggtcctgccacaggtggtgctgggcacggtgggcactcgacacaacatttgcgctcaactgtcttgtccaccttgctgagctggtcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtgattcaccatattacgcagactccggtgggggccgttcaccatcaccagagacaactccaggagcacactatatctaacaaatgcacagcctgagagtcgaggacacggccgtgtattatgtgcgagagatcccaaaggtgaccaccttggtgtcttttgatttctgtggccaaaggggacaagtggtcaccgtctcttcagcctccaccaagggcccatccggtcttccccctggccgccctgctccaggacgcacctccgagacgcacagccggccctggggctgcc

SEQ ID NO: 443545 - DNA, 559 bp, Homo sapiens
  misc_feature: NA.38.28.C06.3.454.heavy.2.nb
gagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtgattcacatattacgcagactccggtgggggccgttcaccatcaccagagacaactccaggagcacactatatctaacaaatgcacagcctgagagtcgaggacacggccgtgtattatgtgcgagagatcccaaaggtgacccaccttggtgtcttttgatttctgtgttcggggaccctaaaggggtaccaaagttcgggtaccacccgttctcttcacgtccctccaccgaacgggccccagtcccggttccttcccccg

SEQ ID NO: 443546 - DNA, 561 bp, Homo sapiens
  misc_feature: NA.38.28.C06.4.454.heavy.2.nb
gaagactgacggtcctgccacaggtggtgctgggcacggtgggcactcgacacaacatttgcgctcaactgtcttgtccaccttgctgagctggtcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtgattcaccatattacgcagactccggtgggggccgttcaccatcaccagagacaactccaggagcacactatatctaacaaatgcacagcctgagagtcgaggacacggccgtgtattatgtgcgagagatcccaaaggtgaccaccttggtgtcttttgatttctgtgttcggggaccctaaaggggtaccaaagttcgggtaccacccgttctcttcacgtccctccaccgaacgggccccagtcccggttccttcccccg

SEQ ID NO: 443547 - DNA, 338 bp, Homo sapiens
  misc_feature: NA.38.3.A03.2.454.heavy.2.nb
ctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcggggattcaaagcatttgatattggggccaaggggaccatggtcaccgtctcttcagcctccaccaacgggcccatcggtcttccccctggccaccctcctccaagacgcacccctctgggggcacagcggccctgggctgcctggtcaaggctacttccacgtgatcga

SEQ ID NO: 443548 - DNA, 611 bp, Homo sapiens
  misc_feature: NA.38.35.D02.1.454.heavy.2.nb
gagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggagctgaggacacggctgtctattactgtgacgaaagacccggcctcgtagtggggtcggggagttatgtcgtggggccaggggaaccctggcccaccgtctcctcacgccctccaccgaacgggccccagtccggtccttccccctggcccgccctgcctccgaggacgccaccctccgagacgcacaggccggcccgtggggctcggcccgtgggtccaa

SEQ ID NO: 443549 - DNA, 620 bp, Homo sapiens
  misc_feature: NA.38.4.A04.1.454.heavy.2.nb
agccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggacctacgactttgactacgtgggggccagggaccctggtcaccgtctcctcacgccctccaccgaacgggcccagtccggtccttcccccgtcggcccacccctcctaccaacgacgccacctcgtcgggggcacgacgccggcccgtggggcctcggcctcgggtaccgaacgg

SEQ ID NO: 443550 - DNA, 359 bp, Homo sapiens
  misc_feature: NA.38.40.D07.1.454.heavy.2.nb
ggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccccaggctccaggcaaggggctgggagtggggtggcaactacatcgtatgatggacgtactgagcactatgcagcctcgtgaagggccattcaccatctcccagagacgattccaaagaacacgatgtatctaacaaatgaaacagcctagaaaccggagacacgctgtgtattactgtgacgaaggattggg

SEQ ID NO: 443551 - DNA, 335 bp, Homo sapiens
  misc_feature: NA.38.41.D08.1.454.heavy.2.nb
ggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggcccacggaaccctggtcaccgtctcctcagcctccaccaagggcccatcggtcttccccctggccacccctcctccaagagcacctctgggggcacgagcggccccctgggctgcctggtcaaggctacttccacgtgatcga

SEQ ID NO: 443552 - DNA, 335 bp, Homo sapiens
  misc_feature: NA.38.42.D09.1.454.heavy.2.nb
ttggccgtattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattactgtatgtatagcagtggctcagggcactactacggtatggacgtctggggccaagggaccacggtcaccgtctcctcagcctccaccaaggcccatcggtctccccctggcaccctcctccaagagcacctctgggggcacacgcggccctgggctgcctggtcaaggctacttccacgtgatcga

SEQ ID NO: 443553 - DNA, 303 bp, Homo sapiens
  misc_feature: NA.38.46.E02.1.454.heavy.2.nb
gtctcatctattaacggtcctggttccaccacatacttcgcagactccgtgaggggccgcttcaccatctccagagacaattccaggaacacactggatctgtatttgaacagcctgagagccgaggacacggccattttattattgttgtaaacagtctgaggcctacaacagtggctgggactggtacttcgatctcgtggggccgtggcaccctggtcactgtctcctcagcctccaccaagggccccatccggtcttccccctggccgcccctgctccgaggacgccacccctccgaga

SEQ ID NO: 443554 - DNA, 462 bp, Homo sapiens
  misc_feature: NA.38.5.A05.1.454.heavy.2.nb
  modified_base (227)..(227): a, c, t, g, unknown or other
tctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggccttgtattactgtgacaaaagtnttttgagtttagagtagtaaggtctaactacgtacggtatggacgtcgtggggccccaagggaccacggtcaccgtctcctcacgccctccaccgaacgggccccatccggtccttcccccgtggccgccctgcctccgaggacgccacctccgagacgccacgacggccggcccctggggcctcggcccgtgggtaccaaaagggccttaaccgttcccgaacggttacggaac

SEQ ID NO: 443555 - DNA, 608 bp, Homo sapiens
  misc_feature: NA.38.53.E09.1.454.heavy.2.nb
agactgacggtcctgccacaggtggtgctgggcacggtgggcactcgacacaacatttgcgctcaactgtcttgtctcaccatggagttgggactgagctggtattttccttttggctattttaaaaggtgtccagtgtgaagtgcagctggtggagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgcaaaaaggccccggtatcggcagtagctaagaggttctttgactcgtggggccaggggaacccggtcaccgtctcctcacgcctccaccgaacgggcccagtccggtccttcccccgtggcccgccctgcctccgaggacgccacccgtccgagacgcacacgccggccctgggcctgcct

SEQ ID NO: 443556 - DNA, 621 bp, Homo sapiens
  misc_feature: NA.38.55.E11.1.454.heavy.2.nb
gagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtgggggtcccttagactctcctgtacagcctctggattcactttagtatgcctggatgacctgggtccgccaggctccaggaagggctggaatgggtgccgtataaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaagagcagttattatgatagtagtggttatctgtactactacggtatggacgtctggggccaagggaccacggtcattgtctccccagcctccaccaagggcccatcggtcttcccctggcaccctcctccaagagcacctctcgggggcacagcggccctgggctgcctggtcaaggactactccacgtgatcga

SEQ ID NO: 443557 - DNA, 401 bp, Homo sapiens
  misc_feature: NA.39.11.A11.1.454.heavy.2.nb
  modified_base (305)..(305): a, c, t, g, unknown or other
caatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagaagtctgagatctgaggacacggccgtctatttctgtgcgagaggacgcggggtatcacttaagtagcgcgggcgactactgggggccaggggaaccctggtccaccggtctcctcagccctccnccaagggcccatcggtcttccccctggcaccctcctccagagcacctctgggggcacagcgccctgggctggcctggtcaaggctactccactagt

SEQ ID NO: 443558 - DNA, 294 bp, Homo sapiens
  misc_feature: NA.39.12.B01.1.454.heavy.2.nb
ctcgctttgctacaccaacctacgcacagaaattccaaggcagagtcacgatttccgctgacgaatccacgaacacggcctatctagaactgagcagccttaagtctgaggacacggccatttattactgtgcaagagatcaccctctcacgtggggccaagggaccagggtcaccgtctcctcagcctccaccaagggcccatcggtctccccctggcaccctcctccaagacgcacctctggggcacagcggccctgggctgcctggtcaaggactacttccactagtgcga

SEQ ID NO: 443559 - DNA, 226 bp, Homo sapiens
  misc_feature: NA.39.12.B01.2.454.heavy.2.nb
cacacccctccttgggagaatcccctagatcacagctcctcaccatggactggacctggagcatccttttcttggtggcagcaacaacaggtgcccactcccaggttcagctggtacagtctggagctgagatgacgaagccgtggggcctagtgaaggtctctgcaaggtcttctggttacacctttacaactatggtatcgtaggttgggtgacgacaggcccc

SEQ ID NO: 443560 - DNA, 342 bp, Homo sapiens
  misc_feature: NA.39.13.B02.2.454.heavy.2.nb
tcttgtggctatgttaaaaggtgtccagtgtgaggtgcagctgttggagtctggggggaggcttggtacaggcggggggggtccctgagactctcctgtacagtctctggattcagctttagcacctatgccatgagctgggtccgccaggctccgaggggaaggggctggagtgggtctcatccattagtggtgccaggtggtggtaatacatattatgtggactccgtgaagggccgttcacatctccagagacaattccaagaacactctgtatctgaccaaatgaacagcctagagcgccgaggacacggccctatattactgtgacgaaatcgtacc

SEQ ID NO: 443561 - DNA, 139 bp, Homo sapiens
  misc_feature: NA.39.13.B02.3.454.heavy.2.nb
tcgcactagtggaagtagtccttgaccaggcagcccagggccgctgtgccccagaggtgctcttggaggagggtgccaggggaagaccgatgggcccttggtggaggctgaggagacggtgaccagggttccctggccc

SEQ ID NO: 443562 - DNA, 415 bp, Homo sapiens
  misc_feature: NA.39.14.B03.1.454.heavy.2.nb
gaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaactgggtccgccaggctccgaggggaaggggctgggagtgggtctcatccattagtcgtagtagtagttacatatactacgcagactcagtgaagggccattcaccatctacagagacaacgccaaagaactcactgtatctgacaaatgaacagcctgagagccgaggacacggctgtgtattac

SEQ ID NO: 443563 - DNA, 358 bp, Homo sapiens
  misc_feature: NA.39.21.B10.1.454.heavy.2.nb
tgggattttcaggtgttttcatttggtgatcaggactgaacagagagaactcaccatggagtttgggctgagctggctttttcttgtggctattttaaaaggtgtccagtgtgaggtgcagctgttggagtctgggggagcttggtacaggccgggggggtccctgagactctcctgtgcagcctctggattcaccttcagcagctatgccatgacctgggtcccgccaggctccgaggggaaggactggagtgggtctcgtctagttagtggaagtggtgcttatacaaactacgcagcctcgtgaacgggccgcttccaccatcctacagacgactacttccaagagcactctgta

SEQ ID NO: 443564 - DNA, 486 bp, Homo sapiens
  misc_feature: NA.39.25.C03.1.454.heavy.2.nb
aagactgacggtccccccaggagttcaggtgctgggcacggtgggcatgtgtgagttttgtcacaagatttgggctcaactctcttgtccagtccctggtgcagctgctgcagtcggggactgaggtgaaggagcctgggtcctcggtgagggtctcctgcaaggcttctggaggcaccttcggcaactatcctatcacctgggtgcgacaggcccctggagaaggacttgagtgggtgggaggcatcatccctcgctttgctacaccaacctacgcacagaaattccaaggcagagtcacgaatttccgctgacgaatccacgaacacggcctatctagaactgagcagccttaagtctagaggacacggccattttatactgtgcaagagactccaccctctacacggtcggggaccaaaggggaccaggggtccaccgtctccctcacgccctaccgaccgaacgggcccctacgtccgttcc

SEQ ID NO: 443565 - DNA, 139 bp, Homo sapiens
  misc_feature: NA.39.25.C03.3.454.heavy.2.nb
tcgcactagtggaagtagtccttgaccaggcagcccagggccgctgtgcccccagaggtgctcttggaggagggtgccagggggaagaccgatgggcccttggtggaggctgaggagacggtgaccgtgccctccagca

SEQ ID NO: 443566 - DNA, 531 bp, Homo sapiens
  misc_feature: NA.39.26.C04.1.454.heavy.2.nb
gagaggagcccagccctgggattttcaggtgttttcatttggtgatcaggactgaacagagagaactcaccatggactttgggctgagctgtcctttttcttgtggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccgagggaaggggctggagtgggtctcatccattagtggtgccagtggtggtaatacatattatgtggactccgtgaagggccgttcaccatctccagagacaattccaaagaacactctgtatctgacaaaatgaaacagcctgagcgccgaggacacggccctatattactgtgacgaaatcctcccgattgagtttgccaccaacttgactccgtcggggccacgggaaccctggtcaccgtctcctcacgccctccaccaacgggcccatcgtcttccc

SEQ ID NO: 443567 - DNA, 150 bp, Homo sapiens
  misc_feature: NA.39.26.C04.2.454.heavy.2.nb
tcgcactagtggaagtagtccttgaccaggcagcccagggccgctgtgcccccagaggtgctcttggaggagggtgccagggggaagaccgatgggcccttggtggaggctgaggagacggtgaccagggttccctggccccaaacccaa

SEQ ID NO: 443568 - DNA, 265 bp, Homo sapiens
  misc_feature: NA.39.28.C06.2.454.heavy.2.nb
gaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccggggggtccctgagactctcctgtgcagcctctggattcaccttaggactattggatgagttggtccgcgaggctgcgaggggagggctggaggtggg

SEQ ID NO: 443569 - DNA, 305 bp, Homo sapiens
  misc_feature: NA.39.30.C08.1.454.heavy.2.nb
ggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccccctgggctgcct

SEQ ID NO: 443570 - DNA, 384 bp, Homo sapiens
  misc_feature: NA.39.31.C09.2.454.heavy.2.nb
aaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggatgggatggatcagcacttacaatggaaacacaaagtatgacacataatttccagggcagagtcatcatcgaccacagacacatccacgagacactgacctacatgacctgagacctgagatctgacgacacggcc

SEQ ID NO: 443571 - DNA, 468 bp, Homo sapiens
  misc_feature: NA.39.34.D01.1.454.heavy.2.nb
  modified_base (197)..(197): a, c, t, g, unknown or other
gcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcgagggcagggtcaccatgactcgggacacgtccatcaaaacngcctacatggaattcagtagactgaagtccaacgacacggccgtgtacttctgtgcgagaggcagagttccacgtggggataagtgacgtaatttcgattggttttgatgtcgtggggaccaaggggacaagtggtcaccgtctcttcagcctccaccaacgggcccatccggtccttcccccgtggccaccctcctccaacgacgccaccgtcgtcgggggccacgagccggcccgtggggcctcggcccgtgggttccgaacgggtacc

SEQ ID NO: 443572 - DNA, 592 bp, Homo sapiens
  misc_feature: NA.39.37.D04.1.454.heavy.2.nb
gagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccagccggggggtccctgagactctcctgtgcagcctctggattcccctttacgagttattggctgagctgggtccgccaggctccgaggggaaggggttggagtgggtggccaacataaagcaagatggaagtcggaaagagtatctggactctgtggaggggccggttcaccatctccagagacaacgccaagaactccgtgcatctgcaaatgaacagtctgagagccgaggacacggctgtttatactgcgcgagagaaggactgggcggtttcgactacgtggggccagggaaccctggtcaccgtctcctcagcctccaccaagggcccatcggtcttcccctggcgccctgctccaggacgcacctccgagagcacagccggccctgggctgcctggtcaaggactacttccactagtgcga

SEQ ID NO: 443573 - DNA, 435 bp, Homo sapiens
  misc_feature: NA.39.39.D06.2.454.heavy.2.nb
ggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccacgcccccgagggaagggctggagttggattggtagaaataaagtgaggaccgggggcaccaactacaatgcgtccctcgaggggtcgagtcaccatatctgcagacaagtccaaagaaccacttctccctgaggctgacccctctgtgaccgccgcggactcggccatatattattgtgcgagtagtttttgcaggatcgttggggcgtatcgacgtcgtggggtcaagggatcgacggtcagtcgtctcctcacgcctccaccaacgggcccaatccggttccttccccc

SEQ ID NO: 443574 - DNA, 344 bp, Homo sapiens
  misc_feature: NA.39.48.E04.1.454.heavy.2.nb
aggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagcttggtacagccgtgggggtccctgagactctcctgtgcagcctctggattcacctttagcagctatgccatgagcgtgggtccgccaggctccgaggggaaggggctgggagtgggtctcgagcctagttagtggtagtggtggtagcacatactacgcagactccgtagaggccgttcacatctcaga

SEQ ID NO: 443575 - DNA, 396 bp, Homo sapiens
  misc_feature: NA.39.53.E09.1.454.heavy.2.nb
gaagactgacggtcctgcaactggtggcgtctgggggaggcttggtccagcctggggggtccctgagactctcctgtacagcctctggattcaggtttagtgacgcctggataaactgggtccgccaggctccgagggaaggggctggagtgggtcgccaacattaagaaagatggaagtgaagaaaaactatgtggactctgtgaagggtccggtttacatctcagggacaacgccatgcattagcatatttgacaaataaacagtctgagagccgaggacacggcttcatatcactgtgcgctgggggcaactatggattcgtggggccaagggaccacggtcaccgtctcctcacgcctccaccgaaacgggcccatccggtccttcccccgt

SEQ ID NO: 443576 - DNA, 321 bp, Homo sapiens
  misc_feature: NA.39.53.E09.2.454.heavy.2.nb
gagccctagccctggactccaaggcctttccacttggtgatcagcactgagcacagaggactcaccatggaattggggctgagctgggttttccttgttgctattttagaaggtgtccaatgtgaggcgcaactggtggcgtcgtgggggaggcttggtccagccgtggggggtccctgagactctcctgtacagcctctggattcaggtttagtgacgcctggataaactgggtccgccaggctccgaggggaaggggctggagtgggtcgccaacattaagaaagataggaagtgaagaaaaactatgtggactctgtg

SEQ ID NO: 443577 - DNA, 439 bp, Homo sapiens
  misc_feature: NA.39.57.F02.1.454.heavy.2.nb
gtacagccggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattccaaacagcacgctgtatttgcacatgaacagcctgagagccgaggacacggccatatattattgtgcgtaaactttccttttgacttggttattatcccctagtgacacgtggggccaaggggaaccctggtcaccgtctcctcacgcctccaccaagggcccatcggtccttcccctcggccaccctcctccaacgacgcacctcgtcgggggcacgacgccgcccgtgggctcgcctggtcaacggac

SEQ ID NO: 443578 - DNA, 444 bp, Homo sapiens
  misc_feature: NA.39.59.F04.1.454.heavy.2.nb
acggcctggggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccggttcaccgtctccagagacaattccaggaacactctctatctggaaatgaatagcctgagagccgacgacacggccatatattattgtgacgaaagaccccaacggtgaccacattggagtcttttgacttcgtggggccaagggacaacggtcaccgtctcttcagcctccaccaagggcccatcggtcttcccctggccgccctgctccaggacgcacctccggagagcacagccggccctgggctgcctggtcaaggctacttccactagtcgcga

SEQ ID NO: 443579 - DNA, 591 bp, Homo sapiens
  misc_feature: NA.39.60.F05.1.454.heavy.2.nb
gagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctatccatgcacgtgggtccgccaggctccgaggggaaggggctggagtgggtctcatccattagtagtagttctagttacatatcttatgcagcctcagtgaagggccattcaccatctccagagacgacgccaagaactcagtgtttctgcaaatgaacagcctgagagccgaggacacggctctttattactgtgcgagagagggtactaaggactactacctggacgtctggggcaaagggaccacggtcaccgtctccttagcttccaccaagggcccatccgtcttcccctggcgccctgctccaggagcacctccgagagcacagccgccctgggctgcctggtcaaggctacttccactagtgcga

SEQ ID NO: 443580 - DNA, 408 bp, Homo sapiens
  misc_feature: NA.39.67.G01.1.454.heavy.2.nb
  modified_base (347)..(347): a, c, t, g, unknown or other
  modified_base (359)..(359): a, c, t, g, unknown or other
ctctcttgtgcagcctctggattcacctttacgagttattggatgagctgggtccgccaggctccagggaaggggctggagtgggtggccaacataaaacaagatggaagtaggaaagaatatgtggactctgtgaagggccggttcaccatctccagagacaacgccaagaactccctggatctgcaaatggacagtctgagagccgaggacacggctgtctattactgcgcgagagaaggagtgggcggtttcgactacgtggggccagggacgccctggtcaccgtcctcctcagcctccaccgaacggggcccatcggtcttccccctggccctgctccaggngcacctccgagngcacagcgccctgggctgcctggtcaaggactacgttccactagtgcga

SEQ ID NO: 443581 - DNA, 281 bp, Homo sapiens
  misc_feature: NA.39.70.G04.1.454.heavy.2.nb
atttcatacattagtagaaatggaaattccatatactacgcagactctgtgaagggccgattcaccatctccagagactattccaagagcactctgtatctgcaaatgaacagcctgagtgccgaggacacggccctatattattgtgcgaaatggtggggggagtgggggctactccgtggtcgtttgactacgtggggccgagggagccctggtcaccgtctcctcacgcctaccgaccgaagggccccatccggtccttccccctggccgcccctgcc

SEQ ID NO: 443582 - DNA, 352 bp, Homo sapiens
  misc_feature: NA.39.71.G05.2.454.heavy.2.nb
tgggattttcaggtgttttcatttggtgatcaggactgaacagagagaactcaccatggagtttgggctgagctggtctttttcttgtggctattttaaaaggtgtccagtgtgaggtgcagctgttggagtctgggggaggcttggtacaggccggggggtccctgagactctcctgtgcagcctctggattcaccttcagcagctatgccatgacctgggtccgccaggctccgagggaaggactggagtgggtctcgtctattagtggaagtggtgcttaacaaactcgcagcctcgtgacgggccgcttcaccatctccagagactattccaagagcactctgtatct

SEQ ID NO: 443583 - DNA, 564 bp, Homo sapiens
  misc_feature: NA.39.73.G07.1.454.heavy.2.nb
ccctgagagctccgttcctcaccatggactggacctggaggatcgtcttcttggtggcagcagtcacaggagccccctcccaggtgaaattggtgcagtctggctttgaggtgaggaagcctggggcctctctgaaagtcccctgccaggcttctggatacatcttcaacgtctattacatccactgggtcgccaggcccctggtcaagggcctgagtgggtggctccatccaaccccaacactggcgacacaaactctgcacagaactttcagggcagggtccaccatcgacccgggacacgtccatcaatacagcctacatggaactcagtagcgtaaaatctgacgacacggccgtctattactgtgcgagaggcagagttccactggggataagtgcgcatttcgatgcttttgatatctggggccaagggacaatggtcaccgtctcttcagcctccaccaaggcccatcggtccttcccctggcaccctcctccaagagcacctctggggcacagcggccctgggctgcctggtcaaggactacttccactagtgcga

SEQ ID NO: 443584 - DNA, 346 bp, Homo sapiens
  misc_feature: NA.39.74.G08.1.454.heavy.2.nb
  modified_base (255)..(255): a, c, t, g, unknown or other
gtgcagcctctggattcacctttaggagttatggcatgaactgggtccgccaggctccaaggaaggggctggagtgggtctcaagtatttatgatgttagtagtagtggagactacgcaacagactacgcagacaccgtgaagggccgttcaccatctccagagacaattccaagaacatggtgtatctaggaaatgtccagcctgagagtcgaagacacggtccgttttattattgtgacgaaagagtcggganatgatatatcgatacgtaccggtattcgtttgtatttcgtgggggcctgggccacccgtggtccaccgtctcctcacgccctccaccgacg

SEQ ID NO: 443585 - DNA, 597 bp, Homo sapiens
  misc_feature: NA.39.81.H04.1.454.heavy.2.nb
cacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacaacgaacaaactatgaccacagaacctccgagggcagagtccaaccatcgaccacagacacatccacgacgaccgaaccggccctaacgagtacgggaccctagggacgggaacggccctaggaacgtacgtaccgtacgggaaaccgaaccgaaacccggggcccgttaggttaacttaccgtggttacggacgtaaagggaaggtaacggttaacgggggtaaaaactttagtttttacggaaaccgtttacggggttaaaccccctttaacggttttacggtaacccggtttaccgggtaccgggggtacccgtaaccgggggt

SEQ ID NO: 443586 - DNA, 596 bp, Homo sapiens
  misc_feature: NA.39.81.H04.2.454.heavy.2.nb
cacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacacaacaaactatgaccacagaacctccgagggcagacgtcaaccatcgaccacagacacatcccacgacgaccgaaccggccctaacgagtacgggaccctagggacgggaacggccctaggaacgtacgtaccgtacgggaaaccgaaccgaaacccggggcccgttaggttaacttaccgtggttacggacgtaaagggaaggtaacggttaacgggggtaaaaactttagtttttacggaaaccgtttacggggttaaaccccctttaacggttttacggtaacccggtttaccgggtaccgggggtacccgtaaccgggggt

SEQ ID NO: 443587 - DNA, 423 bp, Homo sapiens
  misc_feature: NA.39.81.H04.3.454.heavy.2.nb
cacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacaacgaacaaactatgaccacagaacctccgagggcagagtccaaccatcgaccacagacacatccacgagcacggcctacatcggacctgaggagcctgagatctgacgacacggccgtagtacttacgtgtgcgaagagagtacgggggaaa

SEQ ID NO: 443588 - DNA, 421 bp, Homo sapiens
  misc_feature: NA.39.81.H04.4.454.heavy.2.nb
cacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacacaacaaactatgaccacagaacctccgagggcagacgtcaaccatcgaccacagacacatccacgagcacggcctacatcggacctgaggagcctgagatctgacgacacggccgtagtacttacgtgtgcgaagagagtacgggggaaa

SEQ ID NO: 443589 - DNA, 303 bp, Homo sapiens
  misc_feature: NA.39.81.H04.5.454.heavy.2.nb
cacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacaacaactaaaactatcgacccaacaagaaaccc

SEQ ID NO: 443590 - DNA, 472 bp, Homo sapiens
  misc_feature: NA.39.85.H08.1.454.heavy.2.nb
acacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtcccgccaggctccgaggggaaggggctgggagtgggtctctagtttagttagtggtagtggtagtagcacagattacgcagacctccgtgaagggtccggttcaaccatctccagagacaattccaacagcacgctgtatttgcacatgaacagcctgagagccgaggacacggccatatattattgtgcgtaaacttcctttgacttggttattacttcccctagtcgaccacgttcggggccagggaaccctgggtcaccgtcttccgt

SEQ ID NO: 443591 - DNA, 418 bp, Homo sapiens
  misc_feature: NA.39.87.H10.1.454.heavy.2.nb
gcaaccacatctgtcctctagagaatcccctgagagctccgttcctcaccatggactggacctggaggatcctcttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggcttggagtggatgggatggatcgagcgtcttaacaatggtacaacaacaaactatgacacacgaaacctccgagggcaagacgtcaaccatacgaccacagacacactaccaacgacgacgaccggacctaacgacgtacgggaccctagggaacgggacgcccgtaggaacgtactcgta

SEQ ID NO: 443592 - DNA, 416 bp, Homo sapiens
  misc_feature: NA.39.87.H10.3.454.heavy.2.nb
cagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacaggcccctggacaagggcttgagtggatgggatggatcgaacggtacagtggtctcaacaaattatgcacagaagtttcagggcagggtcaccatgaccagggacacgtccatcaatacagcctacatggaactgagcgaggctgagatctagacgacacggccgtgtattatgtgcgagaagatgagtac

SEQ ID NO: 443593 - DNA, 297 bp, Homo sapiens
  misc_feature: NA.39.9.A09.1.454.heavy.2.nb
  modified_base (293)..(293): a, c, t, g, unknown or other
ccctgggattttcaggtgttttcatttggtgatcaggactgaacagagagatctcaccatggaatttgggctgagctggtctttttcttgtggctattttaaaaggtgtccagtgtgaagtgcagttgttggattcgtgggggaggcttggtacagggccggggggtcctgagactctcctgtgcagcttcaggattcagtctttagcagctacgccatgagctgggtccgccaggctccgagggaaggactggagtgggtctcgaggtattggtggcaggtggtgagaccanatac

SEQ ID NO: 443594 - DNA, 269 bp, Homo sapiens
  misc_feature: NA.3.12.B01.2.454.heavy.2.nb
ggggaggcttggtccagcctggggggtccctgagactctcctgtgcagcctctggattcagctttagtaccaattggatgaactgggtccgccaggctccagggaagggctggagtggctggcccacataaacccagatggaacttattcacactatgtggactctgtgaggggccattcaccatctccagagacaacccaagaactcactgttctgcaaatggacagcctgagagccgaggacacggctgtatattactgtgcgagag

SEQ ID NO: 443595 - DNA, 131 bp, Homo sapiens
  misc_feature: NA.3.12.B01.3.454.heavy.2.nb
ctcccaccatagtgggagcaccgactacaacccgtccctcaagagtcgagtcaccatatcagtagacacgtccaagaatcagatctccctgaacgtgacctctgtgacggccgcagacacggcgtttatta

SEQ ID NO: 443596 - DNA, 348 bp, Homo sapiens
  misc_feature: NA.3.17.B06.3.454.heavy.2.nb
cgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggccgccctgctccaggagcacccctccgagagcacaagcgccctgggctgcctggtcaagggcctacttccgagtgcgtct

SEQ ID NO: 443597 - DNA, 440 bp, Homo sapiens
  misc_feature: NA.3.20.B09.1.454.heavy.2.nb
  modified_base (373)..(373): a, c, t, g, unknown or other
cttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaacgggactggagcatattgggtatgtctttcacagtgggagactgactacaacgcctccctcaggagtcgggtcaccatatcagtagacacgtccaagacgccagttctccctgaagctgagggctgtgagcgccgcagacacggccgtgtattacngtgcgagactggccgcaacagactacggtggcaactcctatgctttgatatcgtgggaccaagggac

SEQ ID NO: 443598 - DNA, 383 bp, Homo sapiens
  misc_feature: NA.3.21.B10.1.454.heavy.2.nb
acgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagtttgacagctggggccagggaaccctggtcaccgtctcctcagcctccaccaagggcccatccggtcttccccctggccgcccctgcctccaggacgccacctccgagacgcacacgccggccctgggctgcctggtcaaggactacttccgagtgcgtct

SEQ ID NO: 443599 - DNA, 434 bp, Homo sapiens
  misc_feature: NA.3.23.C01.1.454.heavy.2.nb
  modified_base (174)..(174): a, c, t, g, unknown or other
  modified_base (302)..(302): a, c, t, g, unknown or other
tgaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccncaggctcgagggagggctggagtggtgcatataaaagtagactgctggtgagacaacagactacgctgctgccttcagaggcagattcaccatccttcagagatgaaatcacagagcactctgtttcngacaaatgaacagcctaggaagacgcggacacagccatgtattattgtacattagactactatacgtcccgtgggaccacgggaaccctcgtacaccgtctccgtacacgccctaccaaccgaacgggcccc

SEQ ID NO: 443600 - DNA, 461 bp, Homo sapiens
  misc_feature: NA.3.26.C04.1.454.heavy.2.nb
agactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttatactgtgcgagagtcgtggggtgctacgagtactggtacttcgatctcgtggggcctggcaccctgctgactgtctcctcagccctccaccgaacgggccccagtccggtccttcccccgtggccgccctgcctccgaggacgccacctccgagacgccacagcggccctgggctgcctggtcaaggctacttcgagtgcgtct

SEQ ID NO: 443601 - DNA, 273 bp, Homo sapiens
  misc_feature: NA.3.3.A03.1.454.heavy.2.nb
  modified_base (214)..(214): a, c, t, g, unknown or other
  modified_base (240)..(240): a, c, t, g, unknown or other
aggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggacgtccctcgagactctcctgtgcagcgtctggattcagtttcnctacacatggcatgcacgtgggtccnccagtctcgaggcgaaggggctgcaggtgggtg

SEQ ID NO: 443602 - DNA, 461 bp, Homo sapiens
  misc_feature: NA.3.34.D01.1.454.heavy.2.nb
gttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattatgtgcgagagagagaacattaaatttggcgggctactacgagaacggattgggccgcctggggccaaaggggaccacgggtcatcgtctccgcagcctccaccaacggcccatcggtccttccccctggccacccctcctccaagacgcacctcgtgggggcacgacgcggccctgggctgcctggtcaaggactacttccgagtgcgtct

SEQ ID NO: 443603 - DNA, 500 bp, Homo sapiens
  misc_feature: NA.3.39.D06.1.454.heavy.2.nb
gagaggagcccagcactgggattccgaggtgtttccattcggtgatcagcactgaacacagaggactcaccatggagttttggctgagctgggttttccttgttgtctttttcaaaaggtgtccagtgtgaggtgcagagtggtggagactgggaggaggtcttgatccgaggccggggggtccctgagactctcatgtacaggctctgagttcagcgtcactaaatactacatgagctgggtccgccaggctccgaggggaggggactggactgggtctccagtgttaacagcgatggaagtacatattatgcagactccgtgaagggccgattcaccatctcagagacaattccaagaacactctgtatcttacaaatgaacagcctgagagccgaggacacggccttctattactgtgcgagcgatcgacgggcgagtctgattactttcgtggggccagggaccctggtccaccgtctcctcacgccctccaccga

SEQ ID NO: 443604 - DNA, 347 bp, Homo sapiens
  misc_feature: NA.3.41.D08.1.454.heavy.2.nb
ggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggctacttccgagtgcgtct

SEQ ID NO: 443605 - DNA, 309 bp, Homo sapiens
  misc_feature: NA.3.42.D09.1.454.heavy.2.nb
attgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttcccctggcaccctcctccaagagcacctctggggcacagcggccctgggctgcctggtcaaggactacttccgagtgcgtct

SEQ ID NO: 443606 - DNA, 340 bp, Homo sapiens
  misc_feature: NA.3.55.E11.2.454.heavy.2.nb
gttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgataggaaagaaaaaatattacgcagactccctgaaggtcgattcacatctccagagacaattccaaacaacaccctgtattcgacaaatgaacagcctgagaactgaaagacacggctatctaattacgtgcgagagatcagtc

SEQ ID NO: 443607 - DNA, 402 bp, Homo sapiens
  misc_feature: NA.3.58.F03.1.454.heavy.2.nb
  modified_base (340)..(340): a, c, t, g, unknown or other
ggtgttcccacgggtatagacataaccaatccactccagtccccagggaagggactggagtggattggttatgtctatacccgtgggaacacctactacaacccctccctcaacagtcgggtcaccatatcagtggacccgtcgaagaaccaactctccctgaggttgacctctgtgaccgccgcagacacggtccctttatactgtgcgactgcctcggaaccgggcgcaagggttttgagggcttttgacatctggggccaagggacgatggtcgccgtctcctcagcttccaccaagggcccatcccgtcttccccctggcgccccctgctccaggngccactccgagagcacagcccgccctgggctgccctggtcaaggactacttccgagtgcgtc

SEQ ID NO: 443608 - DNA, 328 bp, Homo sapiens
  misc_feature: NA.3.59.F04.1.454.heavy.2.nb
  modified_base (161)..(161): a, c, t, g, unknown or other
gaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtnactgccccgaatacgtggggccaggggaacccgggtcaccgtctcctcagcctccaccaagggcccatcggtccttccccctggccgccctgcctccaggacgccacctccgagagcacagccggccctgggctgcctggtccaaggactacttccgagtcgcgtct

SEQ ID NO: 443609 - DNA, 605 bp, Homo sapiens
  misc_feature: NA.3.6.A06.1.454.heavy.2.nb
gagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtgctccatcagttcgtttttacactactggagttggatccggcagtccccagggaggactagagtgggtggcatatgcatcacagtgggagcaaccaactaccaacccctcctacgagacgtcgagtcaccatatcaatagacacgtccaaagaaccagttcctccctagacgtcctttagaaagttcctagtaccaaagttcgacgttaggaccgggtaacgtaccgggttacccgttttaagtttaacgtcggtttacggaccggtaacggttaccgttacggggaaaccggggggtaaaatacgttcccgttaaaagttttacggtaaagtttaacggggttttacgggggaaaccccgtaaaaagggggtaaaacccttaaagttacgggggtaccctaaacccgggttccttaccgtttaccgacggtaccccttacc

SEQ ID NO: 443610 - DNA, 433 bp, Homo sapiens
  misc_feature: NA.3.63.F08.1.454.heavy.2.nb
cttagccctggattccaaggcctatccacttggtgatcagcactgagcaccgaggattcaccatggaactggggctccgctgggttttccttgttgctattttagaaggtgtccagtgtgaggtgcagcgtggtggagtcgtgggggaggcctggtcaaggtccgtgggggtccctgacgactctcctgtgcagcctctggattcaccttcagtagctatagcatgaactgggtccgccaggctccgaggggaaggggctgggagtgggtctcatccattagtagtagtagtagttacatatactcgcagactcagtgaagggccattcaccatctccagacgacaacgccaaagactcactgtatctgacaaatgaaacagcctgagagccgaggacacggctgtgttatactgtcgcgtagtttggttggg

SEQ ID NO: 443611 - DNA, 588 bp, Homo sapiens
  misc_feature: NA.3.67.G01.1.454.heavy.2.nb
  modified_base (206)..(206): a, c, t, g, unknown or other
gagaggagccccagccttgggattcccaagtgttttcattcagtgatcaggactgaacacagaggactcaccatggactttgggctgaggtggattttcctgctgccattttaaaaggttccatgtgagctgcgactggtggcgtcgtgggggaggcttgggtgcaggccggggtgggtccctgcgactctcctgtgctaatttcngaacgccccttacaatacagtgtggatgaattgggtccccaggctccgagggagggctgggagtgggttgccataataaaaagtagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 443612 - DNA, 592 bp, Homo sapiens
  misc_feature: NA.3.70.G04.1.454.heavy.2.nb
gcccaccactgggattccgaggtgtttccattcggtgatcagcactgaacacagaggactcaccatggagttttggctgagctgggttttccttgttgctatttcaaaaggtgtccagtgtgaggtgcagctggtggagactgggaggaggcttgatccaggcccgggggtcctgacgactctcctgtgaagtctcgtgggttcactgtcagtagcaactacatgaacgtcgggtccgccaggctccgagggggaacggggccggaggtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttccccctggcgccctgctccaggagcacctccgagagcacagcggccctgggctgcctggtcaacggactacttccgagtgcgtct

SEQ ID NO: 443613 - DNA, 395 bp, Homo sapiens
  misc_feature: NA.3.71.G05.1.454.heavy.2.nb
gagaggagccccagccctgagattcccaggtgtttccattcagtgatcagcactgaacacagaggactcaccatggagttgggactgagctggtattttcctttggctattttaaaaggtgtccggtgtgaagtgcaactggtggagtcgtgggggagcttggtacagcctggcaggtccctgagactctcctgtgcagcctctggattcacctttgatgattatgccatgcacgtgggtccgcaagctccgaggggaacgggcctgggagtggggtctcgaggttattacgttggaatagtgataacagtcggactagtgcggactcgtgtgaagggccgattcaccatctccagacgacaaacgaccaaagaactccctagtatctagacaaa

SEQ ID NO: 443614 - DNA, 343 bp, Homo sapiens
  misc_feature: NA.3.72.G06.2.454.heavy.2.nb
ggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaaggcccatcggtcttccccctggcaccctcctccaagacgcacctcgtgggggcacagcggccctgggctgcctggtcaaggactacttccgagtgcgtct

SEQ ID NO: 443615 - DNA, 375 bp, Homo sapiens
  misc_feature: NA.3.75.G09.1.454.heavy.2.nb
gtgaacatgagtgagcaaaactggatttgtgtgccattttctgataacggtgtccttctgtttgcaggtgtccagtgtcaggtgcagctggtgcaggtcgggggagcgtggtccagcctgggaggtccctgagactctcctgtgcagcctctggcttcatcttcagtagctaataaaatgcactgggtccccaggctccaggcaaggggctggagtgggtggcacttattcatatgatggaagacagatacttcgcagactcgtgaagggccgaagtcaaccatctaccagagacaattcaaagaacacggtgtctctgcaagtgaatagcctgagacgtgacgacacggctgtgtattactgtgcgagagaggg

SEQ ID NO: 443616 - DNA, 439 bp, Homo sapiens
  misc_feature: NA.3.81.H04.1.454.heavy.2.nb
ggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccattcaccatctccagagacaaccccaagaactcactgttctgcaaatggacagcctgagagccgaggacacggctgtatattactgtgcgagagatatgagaaactcaatgaatagaaatcgaggggagtgggggaccaggggaaccctggtcaccgtctcctcacgcctccaccgaacgggcccagtcggtccttcccccgtgccgtccctcgcctcccgaggacgccacctccgagacgcacacgccggccctggggcct

SEQ ID NO: 443617 - DNA, 472 bp, Homo sapiens
  misc_feature: NA.3.82.H05.1.454.heavy.2.nb
gcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcacgtgggtccgccaggctccgaggggaaggggctgggagtgggtccagttatttacaattctggtaccacatacctactccgacccgtgaacgggccattaaccatctaccagagacgattccgagaacacggtgtatcttacaaatgaaacaacctgagagaccgacgacacggtccgtttatactgtgcgagagattcgagtggttcggggacctcgacccttggttctacttcgatctcgtcggg

SEQ ID NO: 443618 - DNA, 378 bp, Homo sapiens
  misc_feature: NA.3.85.H08.1.454.heavy.2.nb
ggagcccagccctgggattttcaggtgttttcatttggtgatcaggactgaacagagagaactcaccatggagtttgggctgagctggtctttttcttgtggctattttaaaaggtgtccagtgtgaggtgcagctggtggagtcgtgggggaggcttggtacagccgtggggggtccctgagactctcctgtgcagcctctggattcacctttagtaattatgccatgagctgggtccgccaggctccgaggggaaggggctgggagtgggtctcagctattagtgatcggtggtaggtaacactactacgcagactcgtgaagggccgcttcaccatcctccagagacaatccaaagacacgctgcatctgacaaa

SEQ ID NO: 443619 - DNA, 385 bp, Homo sapiens
  misc_feature: NA.3.86.H09.1.454.heavy.2.nb
gcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctcgtgggggcacagcggccctgggctgcctggtcaaggactacttccgagtgcgtct

SEQ ID NO: 443620 - DNA, 388 bp, Homo sapiens
  misc_feature: NA.41.12.B01.1.454.heavy.2.nb
gtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggactccgccagcccccagggagggctggagtggattgggagtatctattatagtgggagcacctactaccaacccgtccctacaacgagtcgagtcaccatatcagtagacacgtccaagaaccagttctccctgaacgctgagctctgtcgaccgccgcggacacggccgtgtattactgtcgcgagagtagg

SEQ ID NO: 443621 - DNA, 324 bp, Homo sapiens
  misc_feature: NA.41.23.C01.2.454.heavy.2.nb
agagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgccccgagggacgggaatgggagtggattggtgacatccattatacgtggggacgacgtactactctccgtccctcaagagtcgtctcacctatttcgagggacacgtccatcgaaccccg

SEQ ID NO: 443622 - DNA, 334 bp, Homo sapiens
  misc_feature: NA.41.27.C05.1.454.heavy.2.nb
  modified_base (321)..(321): a, c, t, g, unknown or other
agacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccgccaggctccgaggcgaggggctgggagtggggtggcaggtgtgtctatttccatggaggaaatcaaagtctaacgggtnacgtttccggtga

SEQ ID NO: 443623 - DNA, 280 bp, Homo sapiens
  misc_feature: NA.41.33.C11.1.454.heavy.2.nb
  modified_base (246)..(246): a, c, t, g, unknown or other
gagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggaggtccctgagactctcctgtgtagcgtctggattcaccttcaacagacatggcatgcacgtcgggtcccnccaggcctaccgaggaccaaaggggactggggag

SEQ ID NO: 443624 - DNA, 301 bp, Homo sapiens
  misc_feature: NA.41.36.D03.2.454.heavy.2.nb
caggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctccaaggacacctaccaaaggcaggtgtctttagtatgaccaacatcggaccctgcggacaccaggcacatattactgtgcatgggta

SEQ ID NO: 443625 - DNA, 274 bp, Homo sapiens
  misc_feature: NA.41.36.D03.3.454.heavy.2.nb
gagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcgttggtacgagggcgggggggtccctgagactctcctgtgcagcctcggattcatcttcagtgactatgccatgaactggtccgccaggcctccgaggggaagggctggagttggg

SEQ ID NO: 443626 - DNA, 276 bp, Homo sapiens
  misc_feature: NA.41.45.E01.1.454.heavy.2.nb
  modified_base (237)..(237): a, c, t, g, unknown or other
gagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgagcctctggatttagttcagtagttctggcatgcacgtgggtcccnccaggcctccgagggcgaagggggccgagtcgggttggc

SEQ ID NO: 443627 - DNA, 403 bp, Homo sapiens
  misc_feature: NA.41.5.A05.1.454.heavy.2.nb
agccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccctggcgggtccctgaggctctcctgtttaggttctggattcgtcttcagcgactactacctgagttgggccgctggctccgagggaagtctggagtggattgcgtacatcagtcattctgacttcgaccgtctactacgcagctctggtggaggccgattccaccattccaggacgacgccgcgaactcactttatctgcagatgactagtctgacgacccgaagacacggccatatat

SEQ ID NO: 443628 - DNA, 289 bp, Homo sapiens
  misc_feature: NA.41.55.E11.1.454.heavy.2.nb
ccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccgcaggctccgaggggaagggctgggagtgggtctcagtctatttatactggtgtattt

SEQ ID NO: 443629 - DNA, 286 bp, Homo sapiens
  misc_feature: NA.41.57.F02.1.454.heavy.2.nb
gagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgaggggaggggaagtgggagtggagttggtgacatccattagtacgtggggcgacgtactactctccgtccc

SEQ ID NO: 443630 - DNA, 419 bp, Homo sapiens
  misc_feature: NA.41.6.A06.1.454.heavy.2.nb
  modified_base (412)..(412): a, c, t, g, unknown or other
gaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctcttttggctcactcacctacgcacgagaccttccggggcagaattacgattaccgcggacaagtccacagacacagtctccatgacaatgagttcttgaaatccgacgacacggccgtctactactgtgcgagcggtccgtaccccagctacgcagtggacncctttga

SEQ ID NO: 443631 - DNA, 277 bp, Homo sapiens
  misc_feature: NA.41.70.G04.1.454.heavy.2.nb
  modified_base (147)..(147): a, c, t, g, unknown or other
gccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttcncactcgtcactcctggagagggcgttgtcgtgggtgcggcacgcccccggaaggccctggagtggatcgcactcacttatggaatgacgatatacgatatagtccttctctgacgaccagactcacgcct

SEQ ID NO: 443632 - DNA, 367 bp, Homo sapiens
  misc_feature: NA.41.71.G05.1.454.heavy.2.nb
  modified_base (320)..(320): a, c, t, g, unknown or other
  modified_base (334)..(334): a, c, t, g, unknown or other
ggggactgaacagagagaactcaccatggagtttgggctgagctggcttttcttgtggctgttttaaaaggtgtccagtgtgaagtgcagctgttggagtcggggggaggcttggtacagccgggggggtccctgacactctcctgtgcagcctctggattcgcctttaatacctatgccatgatcgtgggtccgtcacggccccgaggggaaggggctggagtgggtctcgatccgattactggtggtagtgccacaaatgtcgcagactccgtgaacgggccgcttcatcccgtctccaggacatccaagatacggtnttctgcagatgaanacgcctgcgagtggacgacgaccggtcccttta

SEQ ID NO: 443633 - DNA, 304 bp, Homo sapiens
  misc_feature: NA.41.73.G07.1.454.heavy.2.nb
  modified_base (297)..(297): a, c, t, g, unknown or other
gcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggaggtccctgagactctcctgtgaagcctctggtatttagttcagttagttctggcatgcacgtgggtccccaggctccgaggcaaggggccgagtggttggctagttatagcatatgatggaacttagatntatgcag

SEQ ID NO: 443634 - DNA, 333 bp, Homo sapiens
  misc_feature: NA.41.74.G08.1.454.heavy.2.nb
  modified_base (270)..(270): a, c, t, g, unknown or other
accacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactggtgcgccaggcccctggacaagggcttgagtggatgggtggaatcatccctnttttggctccactcactacgcaacgagcgttccggggcagattacgattaccgcgacaagtcc

SEQ ID NO: 443635 - DNA, 424 bp, Homo sapiens
  misc_feature: NA.41.78.H01.1.454.heavy.2.nb
tgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggcttgcccagaagttccaaggcagagtagtatgaccaggagcacctccccaggtacagtctacatggaactgagcagcctgagatctgaggacacggccgtgtatttctgtgcgagagccacagcacctggcttgacttggtcggggccagggaaccctggtccaccgggtctcctcacgccctccaccgaacgggccccagtccggtccttcccccgtggccgccctgccttcgaggcgccaccttc

SEQ ID NO: 443636 - DNA, 344 bp, Homo sapiens
  misc_feature: NA.41.78.H01.2.454.heavy.2.nb
gagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggaaagccgtggggagtcccttagactctcctgtgcagcctctggattcactttcagtaacgcctggatgacctgggtccgccaggctccgagggaggggctggagtgggtgccgtattagaaccaaagctgacggtgggacagcagactacgctgcacccgtgaaaggcagactcaccatc

SEQ ID NO: 443637 - DNA, 353 bp, Homo sapiens
  misc_feature: NA.41.84.H07.1.454.heavy.2.nb
ggagcccagccctgggattttcaggtgttttcatttggtgatcaggactgaacagagagaactcaccatggagtttgggctgaggtggtctttttcttgtgactattttaaaaggtgtccagtgtgaggtggccctgttggagtcgtgggggaggattggcacagccgtgggggtccctgagactctcctgtgcagcctctggccttccccttaggagctatgccatgacctgggtccgccaggctccgaggggaacggggctcgagtgggtctcgacagttggcgctagtgcaactgacacaatactaacggagagtccgtgaacgggccgcttcaccatctccagagacaa

SEQ ID NO: 443638 - DNA, 349 bp, Homo sapiens
  misc_feature: NA.41.86.H09.1.454.heavy.2.nb
tgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgagggagggaatggagtggagttggtgacatccattatacgtggggcgacgtactactctccgtccccctcaagacgtcgtctcacctttcgagggacacgtccatcgaaccgcttctccctgaaactgaccctc

SEQ ID NO: 443639 - DNA, 461 bp, Homo sapiens
  misc_feature: NA.44.12.B01.1.454.heavy.2.nb
agtcatggacctcctgtgcaagaacatgaagcacctgtggttcttcctcctgctggtggcggctcccagatgggtcctgtcccagctgcagctgcaggagtcgggcccaggactgggtgaagccttcgggagaccctgtcccctcacctgcactgtctctggtgctccatcagcagtagtagttactactggggctggatccgccacgcccccgagggaaggggctggagtggagttgggagtatctattatagtgggagcacctactacaacccgtcctcaacgagtcgagtcaccatatcagtagacacgtccaagaaccagttctccctgaacgctgagctctgtcgaccgccgcggacacggccgtgtattactgtgcgagagtagggcagttcgtcaccaactactttgaccacgtcggggccaggggacccttgggtccaccggtctccgtcacg

SEQ ID NO: 443640 - DNA, 465 bp, Homo sapiens
  misc_feature: NA.44.19.B08.3.454.heavy.2.nb
ccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggtcgttgtctggggtgcggcacggccccccggaaaggccctggagtggatcgcactcacttatggaatgacgatatacgatatagtccttctctgacgaccagactcacgctccacgaagacacgtaccaaaaaccaggtggtccttacattgaccaacgtggaccctgtggacacaggcacatatttctgtcgcccacttcatgaccacaatgaccacggcttcttcgaaccctgggccagggactccgaggtcaccgtctcactcagcctccaccaacgggcccagtccggtccttccccc

SEQ ID NO: 443641 - DNA, 296 bp, Homo sapiens
  misc_feature: NA.44.21.B10.1.454.heavy.2.nb
cccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccgccaggctccgaggggaaggggctgggagtggcttgggccgacaagtaaaaacaagttgaccagcttta

SEQ ID NO: 443642 - DNA, 309 bp, Homo sapiens
  misc_feature: NA.44.23.C01.2.454.heavy.2.nb
gccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaccctggtcaccgtctcctcagcctccaccaaggcccatcggtccttccccctggccccctgcctccaggacgccacctccgagagcacagcggccctgggctgcccctggtcaaggactacttcctattactgt

SEQ ID NO: 443643 - DNA, 491 bp, Homo sapiens
  misc_feature: NA.44.23.C01.3.454.heavy.2.nb
tgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggattggtgacatccattatactggggcgacgtactactctccgtccctcaagagtcgtctcaccatttcgagggacacgtccatcgaaccgcttctccctgaaactcgacctccgtgaccgccgcggacacggtccgtttattctgtgcgaggcgagactggtctttcaatctatggggcctggcacccgtggtcactcgtctcctcacgcttccaccaacgggcccatccggtccttcccccgtggccgccctgcctcc

SEQ ID NO: 443644 - DNA, 328 bp, Homo sapiens
  misc_feature: NA.44.23.C01.5.454.heavy.2.nb
cataatggaagcaccagctataacccgtccctcaagagtcgactcaccatctccgtcgacacgtccaagagacagatgtccctgagtctgacgtctgtgaccgccgcggacgcggctgtgtatttctgtgcgagacggccctggtaccagcgagtggtacctctactactactctctggacgtctgggggcccaggggaccgcggtcaccgtctcctcagcctccaccaagggcccatcggtcttccccctggcaccctcctccaagagcacctctgggggcacagcggccctgggctgccctggtcaaaggactctctatatactgt

SEQ ID NO: 443645 - DNA, 573 bp, Homo sapiens
  misc_feature: NA.44.27.C05.1.454.heavy.2.nb
agacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccgccaggctccaggcgaggggctgggagtggggtggcaggtgtgtcatttcatggaggaaatcaaagtctacggtgattccgttgagggccgattcaccatctccagagacaattccgagaacacagtgtctcttacaaatgaacagcctgagacctcaggacacggccgtgtattttgtgcgagactatctgtttaccaaaattcggttcattccgacgcctggggccagggaccctggtcaccgtctcctcggcctccacacgggcccatccggtctccccctggccgccctgctccagacgcacctccgagagcacagcgccctgggctgc

SEQ ID NO: 443646 - DNA, 576 bp, Homo sapiens
  misc_feature: NA.44.27.C05.2.454.heavy.2.nb
agacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccgccaggctccaggcgaggggctgggagtggggtggcaggtgtgtcatttcatggaggaaatcaaagtctacggtgattccgttgaggccgattcaccatctccagagacaattccgagaacacagtgtctcttacaaatgaacagcctagacgacctcaggacacggccgtgttattttgtgcgagactatctgtttaccaaaatcggttcattccgacgcctggggccagggaaccctggtcaccgtctcctcggcctccaccaagggcccatccggtctccccctggccgccctgctccagacgcacctccgagagcacagcgccctgggctgc

SEQ ID NO: 443647 - DNA, 575 bp, Homo sapiens
  misc_feature: NA.44.27.C05.3.454.heavy.2.nb
agacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccgccaggctccaggcgaggggctgggagtggggtggcaggtgtgtcatttcatggaggaaatcaaagtctacggtgattccgttgagggccgattcaccatctccagagacaattccgagaacacagtgtctcttacaaatgaacagcctgagacctcaggacacggccgtgttattttgtgcgagactatctgtttaccaaaatcggttcattccgacgcctggggccagggaaccctggtcaccgtctcctcggcctccaccaagggcccatccggtctccccctggccgccctgctccagacgcacctccgagagcacagcgccctgggctgc

SEQ ID NO: 443648 - DNA, 440 bp, Homo sapiens
  misc_feature: NA.44.27.C05.4.454.heavy.2.nb
agacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccgccaggctccaggcgaggggctgggagtggggtggcaggtgtgtcatttcatggaggaaatcaaagtctacggtgattccgttgaggaacgggggtcccgtaatttcccgaacccgtaacttacccgttacccgaaggtaacggtaaaccgtaaaacgtttaccccggaaacgtaaaacccgaaccgtaacgttacggtt

SEQ ID NO: 443649 - DNA, 438 bp, Homo sapiens
  misc_feature: NA.44.27.C05.5.454.heavy.2.nb
agacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccgccaggctccaggcgaggggctgggagtggggtggcaggtgtgtcatttcatggaggaaatcaaagtctacggtgattccgttgaggacggggtcccgtaatttacccgaacccgtaacttacccgttacccgaacggaacgtaaaccctaaaacgtttaccccggaaacgtaaaacccgaaccgtaacgttacggtt

SEQ ID NO: 443650 - DNA, 381 bp, Homo sapiens
  misc_feature: NA.44.29.C07.1.454.heavy.2.nb
  modified_base (308)..(308): a, c, t, g, unknown or other
cgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcagcccccaggaaaggccctggagtggcttgcactcatttatgggatgatgataggcgctacagtccatctctgaagagccagactctccatccaccgggacgccctaccaatacgcaggtnactccgttagagtcggaccaacgacgtcggcccctggaccggacacagccaacactactactgccgcacacat

SEQ ID NO: 443651 - DNA, 351 bp, Homo sapiens
  misc_feature: NA.44.29.C07.2.454.heavy.2.nb
gtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaaagggaccacggtcaccgtctcctcagctccaccaaggccccatcggtcttccccctggcgccctgctccaggagccacctcgtgggggcacagcggccctggggctcgcctggtcaaaggactacttcctatatactgt

SEQ ID NO: 443652 - DNA, 352 bp, Homo sapiens
  misc_feature: NA.44.30.C08.1.454.heavy.2.nb
ggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcaggggacgtcggtcaccgtctctcagcttccaccaggcccatcggtcttcccctggccgccctgcctccagagcaccctctgggggcacagcggccctgggctgcctggtcaaggactacttcctatactactgt

SEQ ID NO: 443653 - DNA, 408 bp, Homo sapiens
  misc_feature: NA.44.33.C11.2.454.heavy.2.nb
gagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagactctcctgtgtagcgtctggattcaccttcaacagacatggcatgcacgtgggtccgccaggcctccgaggcaaggggctgggagtgggtgctacttatatggtatgatggaaataataatattatgtagattcgtagaagggccgattcacatctcagagacaattcgaaagaacacactatatctaggaaatagaatagctagggagccgaaggacacggc

SEQ ID NO: 443654 - DNA, 343 bp, Homo sapiens
  misc_feature: NA.44.33.C11.3.454.heavy.2.nb
gagaggagcccagcaccagaagtcggcggtgtttccagtcggtgatcagcaccgaacacagaggactcaccatggagtttgggctgacctgggttttcctcgttgccctcttaagaggtgtccagtgtcaggtgcaattcgtggagtcgtgggggaggcgtggccccaggtagggggtccctgagactctcctgtgcagcctctggattcaccttcgataattggaatatgcagtggtccgcaggctccaggcgaggggctgggaggtgggtggcaggtgtgtcatttcagtggagaaatcaagttctacggtgattccgtgagggcctaattccaccatcct

SEQ ID NO: 443655 - DNA, 457 bp, Homo sapiens
  misc_feature: NA.44.35.D02.3.454.heavy.2.nb
tgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggctggagtggattgggcgcatctataacagtggcagcaccaactaccaaccccgcctacaagagtcgacgtcaccatgtcactagcaggtccaaagaaccagttcctaccctagaaattgacttctgtgaccgccgcggacacggccgtatattattgtgcgagagattcctatcgatacagtagaggacgggggcaacgtggctcgacccgtggggccacgggaaccctggtccaccgtctcc

SEQ ID NO: 443656 - DNA, 436 bp, Homo sapiens
  misc_feature: NA.44.36.D03.4.454.heavy.2.nb
  modified_base (314)..(314): a, c, t, g, unknown or other
gagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacttggtccagcctggagggtccctgagactctcctgtgtcgcctctggattcaccatcagtgaccactatatggactgggtccgccaggctccgaggggaaggggctgggagtggcttggccgacaagtaaaaacaagttcgaccagtctttancacagacgtacgccgcgtctgtagaaagccagacttccaccctctacaaagagatgacttcaaagactcattgattctgacgaatgaactaactagaaaaccgaggacacgggcaagtgtat

SEQ ID NO: 443657 - DNA, 422 bp, Homo sapiens
  misc_feature: NA.44.36.D03.5.454.heavy.2.nb
ttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgcgagaccggtagaggacaagacaaagaaaagtaagttctttagactacgtggggaccagggaacccgtggtcaccgtctcctcacgcctccaccaacgggcccacgtccggtccttcccccgtggccacccgtcctaccacgacgcc

SEQ ID NO: 443658 - DNA, 418 bp, Homo sapiens
  misc_feature: NA.44.36.D03.6.454.heavy.2.nb
caggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaaatcctaacagtacatctctgaagagcagtttaaccatctaccaaggacacctaccaaaaggcaggtgtctttagtatgaccaacatggaccctgcggacaccaggcacatattactgtgcacgggtaatggacgggaaaagaaacagctggtttctgtattataagtcttaccatctggacgtcgtggggacaaagggaccacggtcaccgtctcctcacgcttccaccgaacgggcc

SEQ ID NO: 443659 - DNA, 393 bp, Homo sapiens
  misc_feature: NA.44.36.D03.7.454.heavy.2.nb
gagaggtgccttagccctggattccaaggcatttccacttggtgatcagcactgaacacagaggactcaccatggagttggggctgcgctgggttttccttgttgcttattttagaaggtgtccactgtgaggtgcggctgggtggagtcgtgggggaggcttgggtacgagggcggggggggtccctggagactctcctgtgcagcctctggattcatcttcagtgactatgccatgaactgggtccgccaggcctccgaggggagggctggagtgggtttccatatgttaatattgctggagataccacctactacgcagactctgtgaagggccattcacctaattccgaggacaatgaccaaagaactcactgtatctaggaaatgaac

SEQ ID NO: 443660 - DNA, 364 bp, Homo sapiens
  misc_feature: NA.44.36.D03.8.454.heavy.2.nb
cggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgttttatttctgtgcgaggcgagactggtctttcaatctagtggggccgtggcaccctggtcactgtctcctcagcttccaccaagggccccatccggtcttcccccgtggccgcccctgcctccgaggacgccacctcgtcgggggccacgacgccggcccgtggggctgcctgggtcaatgactacttcctatatactgt

SEQ ID NO: 443661 - DNA, 574 bp, Homo sapiens
  misc_feature: NA.44.38.D05.3.454.heavy.2.nb
gaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgcaaatgaacagtctgagagccgaggacacggctgtgtattactgtgcaagagccggtgcgggagttcggggattgcatactactactacggtatggacgtcgtggggccaagggaccacggtcaccgtctcctcacgcttccaccaacgggcccacgtcggtccttcccccgtggcccgccctgcctccaggacgcacctctcgggggcacgagcggccctgggctgcctggtcaaggactacttcctatatactgt

SEQ ID NO: 443662 - DNA, 332 bp, Homo sapiens
  misc_feature: NA.44.39.D06.5.454.heavy.2.nb
  modified_base (240)..(240): a, c, t, g, unknown or other
  modified_base (306)..(306): a, c, t, g, unknown or other
gagcccagcactggaagtcgccggtgtttccattcggtgatcatcactgaacacagaggactcaccatggagtttgggctgagctgggttttcctcgttgctcttttaagaggtgtccagtgtcaggagcacttggtggagtcgtgggggaggcgtggtccaggcccgggaggtccctgagactctcctgtgtagcctgtgggttctcattcgatagatttggttgctacgtgggtcccnccaggcctccgaggcaaggggccgagtgggtgcagtcatctccgagatggaatgagaagtattacnagactccgtgaagggcattcaccatc

SEQ ID NO: 443663 - DNA, 352 bp, Homo sapiens
  misc_feature: NA.44.41.D08.2.454.heavy.2.nb
ggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaaggcccatcggtcttccccctggccaccctcctccaacgacgcacctctgggggcaacagcggccctgggcctgcctggtcaaggactacttcttatatactgt

SEQ ID NO: 443664 - DNA, 445 bp, Homo sapiens
  misc_feature: NA.44.43.D10.1.454.heavy.2.nb
ctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctcataaacacagcctacatggagctgagcagcctgagatctgaggacacggccgtgtattactgtgcgagatcccgaaagtatagcagctcgtcggggagtggttccgaccccgtggggcccaggggaaccctggtcaccgtctcctcagccttaccaccaacgggccccagtccgtccttcccccgtcggccgccctcgcctccgacggacgcacctcgtcggggcacgacgccggcccgtgggctcgcccgtggtcaacgg

SEQ ID NO: 443665 - DNA, 349 bp, Homo sapiens
  misc_feature: NA.44.45.E01.1.454.heavy.2.nb
attgggcgcatctataacagtggcagcaccaactacaacccccgccctcaagagtcgagtcaccatgtcactagacaggtccaagaaccagttctccctgaaattgacttctgtgaccgccgcggacacggccgtatattattgtgcgagagattcctatcgatacagtagaggacggggggcaacgtggctcgaccccgtggggccagggagccctggtccaccgtctcctcacgccctccaccaagggcccatccggtcttccccctggccaccctcctccaagacgcacctccgagagcacagcggccctgggctgcctggtcaaggcctacttcctatatactgt

SEQ ID NO: 443666 - DNA, 316 bp, Homo sapiens
  misc_feature: NA.44.45.E01.2.454.heavy.2.nb
gtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggagccctggtccaccgtctcctcacgccctccaccaagggcccatccggtcttccccctggccagccctcctccaagacgcacctccgagagcacagcggccctgggctgcctggtcaaggcctacttcctatatactgt

SEQ ID NO: 443667 - DNA, 301 bp, Homo sapiens
  misc_feature: NA.44.46.E02.1.454.heavy.2.nb
gtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactacgtggggccggggaaccctggtcaccgtctcctcagcctccaccaagggccccatcggtcttccccctggccgccctgcctccaggagcacctccgagagcaccagcggccct

SEQ ID NO: 443668 - DNA, 483 bp, Homo sapiens
  misc_feature: NA.44.53.E09.1.454.heavy.2.nb
ctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacacgttttccctgaaacgtgagttctgtggccgccgccgacacggctgtctactactgtgtcagacatgggtccgcctatggcaggtcgtctcaaatttctactacgcttggggactcgtggggaccaaggggaccacggtcaccgtctcctcatccctcacgcctccaccaagggcccatcggtccttccccctggcccg

SEQ ID NO: 443669 - DNA, 410 bp, Homo sapiens
  misc_feature: NA.44.53.E09.2.454.heavy.2.nb
  modified_base (235)..(235): a, c, t, g, unknown or other
cccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccncaggctccgaggggagggctggagtgggtgccgtatagaaccaaagctggacggtggacagcagactacgctgcacccgtgaaaggcagattcaccatctacaagagatgaattacaaaagtacggtgtctctgcagatagaacagcctagaaaccaccgagacacgacgccgta

SEQ ID NO: 443670 - DNA, 251 bp, Homo sapiens
  misc_feature: NA.44.53.E09.4.454.heavy.2.nb
gtccagcccgggaggtccctgagactctcctgtgtagcctctgggttctcattcgatagattttggtttgcactgggtccgccaggctccaggcaaggggccggagtgggtggcagtcatctccgacgatggaagtgagaagtattactcagactccgtgaagggccattcacatctcagagacaattcaagatatgctgtattgacaaatgaacagcgtgagagttgacgacacgtctgtttatactgtg

SEQ ID NO: 443671 - DNA, 597 bp, Homo sapiens
  misc_feature: NA.44.55.E11.1.454.heavy.2.nb
agcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgaggggaaggggctggagtgggtctcagtcatttatactggtgtatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagcgcacctctgggggcaccagcggccctgggctgcctggtcaaggactactcctatatactgt

SEQ ID NO: 443672 - DNA, 296 bp, Homo sapiens
  misc_feature: NA.44.56.F01.2.454.heavy.2.nb
ctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtacgaaaacacggtgtatttacaaatgaacagtctaagagtcgaggacacggctgtctactattgtgtgagtacctttatgatttcgacgtttgggggatttatcgtttgggcccacgacgtgggggcaggg

SEQ ID NO: 443673 - DNA, 438 bp, Homo sapiens
  misc_feature: NA.44.57.F02.1.454.heavy.2.nb
gagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgaggggacggggaagtggagtggagttggtgacatccattatacgtggggcgacgtactactctccgtccccctcaagagtcgtctcacctttcgagggacacgtccatcgaaccgcttctccctgaaactgacctccgtcgaccgccgcggacacggtccgtttatttctgttgcgaggcgagactggtctttcaatctagtggggcctggcacccgtggtcact

SEQ ID NO: 443674 - DNA, 272 bp, Homo sapiens
  misc_feature: NA.44.57.F02.2.454.heavy.2.nb
aagaagcctggggcctcagtgaaggtttcctgcaaggcttctggatacaccttcaatatttatgctatgcagtgggtgcgccaggcccccggacaaaggcttgagtggatgggatggatcaacgctggcaatggtgacacaagatattcacagaagttccagggcagagtcaccattaccagcgacacatccgcgagcacagcctacatggagctgagcagcctgagatctgaagacacggctgtatattattgtgcgaaggaggaaagggg

SEQ ID NO: 443675 - DNA, 460 bp, Homo sapiens
  misc_feature: NA.44.6.A06.1.454.heavy.2.nb
gaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccacggcccctggacaagggcttgagtggatgggtggaatcatccctcttttggctcactcacctacgcacgagaccgttccggggcagaattacgattaccgcggacaagtccacagacacagtctccatgacaatgagttcttagaaatccgacgacacggccgtctactactgtgcgagacggtccgtaccccagctcgcatggagcctttgagatcgtgggggcagggaaccctggtcattgtcacctcacg

SEQ ID NO: 443676 - DNA, 198 bp, Homo sapiens
  misc_feature: NA.44.60.F05.1.454.heavy.2.nb
ttggccatatctattatactgggtccaccaactacaatccgtccctcaagagtcgagtcaccatgtctttagacacgtccaagaaccaattctccctgaacctgagctctctgaccgttgcggacacggccgtctattactgtgcgaggaacatagcagcagcgtgggttggtcttattttgagttacgtgggcagtc

SEQ ID NO: 443677 - DNA, 288 bp, Homo sapiens
  misc_feature: NA.44.64.F09.1.454.heavy.2.nb
ggatgaagccctatagtggcaacacgggctttgcccagaagttccaaggcagagttagtatgatcaggagcacctccccaggtacagtctacatggaactgagcagcctgagatctgaggacacggccgtgtatttctgtgcgagagccaccagcacctggcttgacttgtggggccagggaccctggtcaccgtctcctcagcctccaccaacgggcccatccggtccttccccctggccgccctgcctccgaggacgccacccgtccgagacgcacagcccggccc

SEQ ID NO: 443678 - DNA, 428 bp, Homo sapiens
  misc_feature: NA.44.67.G01.1.454.heavy.2.nb
agcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgaggggaaggggctggagtgggtctcgagtcatttatactggtgatttcacatactacgcagactccgtgaagggccgattcaccatctccagggacaattccaggaacacggtttatcttacaaatgaaacaacctgagaggacgacgacacggccgtctattacgtgtagcgagacaagtcgg

SEQ ID NO: 443679 - DNA, 288 bp, Homo sapiens
  misc_feature: NA.44.67.G01.2.454.heavy.2.nb
  modified_base (234)..(234): a, c, t, g, unknown or other
agcccagcactgggattccgaggtgtttccattcggtgatcagcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctctggattcaccttgataatggaatatgcagtggtccnccaggctccgaggcggaggggctgggaggtggggtggcgaggtgtgtcatttca

SEQ ID NO: 443680 - DNA, 418 bp, Homo sapiens
  misc_feature: NA.44.70.G04.1.454.heavy.2.nb
  modified_base (301)..(301): a, c, t, g, unknown or other
gccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacgcccccggaaaggccctggagtggatcgcactcacttattggaatgacgatatacgatatagtccttctctgacgaccagactcacgcctcacgaagacacgtaccaaaaccnggtgtccttacattgaccaacgtgaccctgtggacacaggcacatattctgtgcccattcatgaccacaatgaccacgggcttctcgaaccctggggccaagggaactccaggtcac

SEQ ID NO: 443681 - DNA, 336 bp, Homo sapiens
  misc_feature: NA.44.70.G04.3.454.heavy.2.nb
  modified_base (238)..(238): a, c, t, g, unknown or other
ggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggagtccctgagactctcctgtgaagcctctggtatttagttcagtggttctggcatgcacgtgggtccnccaggctccgaggcgaaggggccgagtggttggcagttaagcacatgatggaagttctagaaattattatgacagactccgtaggaaacggcctattc

SEQ ID NO: 443682 - DNA, 421 bp, Homo sapiens
  misc_feature: NA.44.71.G05.2.454.heavy.2.nb
ggggactgaacagagagaactcaccatggagtttgggctgagctggctttttcttgtggctgttttaaaaggtgtccagtgtgaagtgcagctgttggagtcggggggaggcttggtacaggccggggggtccctgacactctcctgtgcagcctctggattcgcctttaatacctatgccatgatctgggtcctcacggccccaggggaaggggctggagtgggtctcatccattactggtggtagtgccacaaatgtcgcagactccgtgaacgggccgcttcatccgtcctccgagggacaattccaaagatacggtgtttctgcagatgaagagcctgcgagtggacgacacggccctttatacctgtgccgaggagggtcgcgaagaacgttacaaacaataacaaagttattaac

SEQ ID NO: 443683 - DNA, 587 bp, Homo sapiens
  misc_feature: NA.44.72.G06.1.454.heavy.2.nb
gccttagccctggactccaaggcctttccacttggtgatcagcactgagcacagaggactcaccatggaattgggactgagctgggttttccttgttgctattttagaaggtgtccagtgtgaggtgcaactggtggagtcgtgggggaggcttggtccagccgtgggggtccctgagactctcctgtgcagcctctggattcacctttagtagttattggatgaactgggtccgccaggctccgaggggaagggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagcctccaccaagggcccatcggtctccccctggccgccctgctccaggacgcacctccgagacgcacagccggccctgggctgcctggtcaaggactacttcctatatactgt

SEQ ID NO: 443684 - DNA, 349 bp, Homo sapiens
  misc_feature: NA.44.72.G06.2.454.heavy.2.nb
ggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagcttccaccaaggcccatcggtcttccccctggcgccctgctccaggacgcacctcgtcgggggcacagcggccctgggctgcctggtcaaggactacttcctatatactgt

SEQ ID NO: 443685 - DNA, 392 bp, Homo sapiens
  misc_feature: NA.44.73.G07.2.454.heavy.2.nb
cactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcactgggtccccaggcctccaggcaagggggctgggagtggggtggctaattatatccagaagaagtggaattggaaagacacgtaacgggagaccgtccggaagggccgattcaccgtctccagagacaattccaaggaacacactgcatctgacaaatagtaacaacctacaa

SEQ ID NO: 443686 - DNA, 393 bp, Homo sapiens
  misc_feature: NA.44.73.G07.3.454.heavy.2.nb
  modified_base (272)..(272): a, c, t, g, unknown or other
  modified_base (349)..(349): a, c, t, g, unknown or other
gcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagttcagtagttctggcatgcactgggtccgccaggctccaggcaaggggccgagtggttggctagttanagcatatgatggaacttcagatattatgcagactcgtgaagggccattcacatctccagagacaattcccggaaacnactctgtacctggaaatgaatcagcctgagaggcgaggactcgg

SEQ ID NO: 443687 - DNA, 477 bp, Homo sapiens
  misc_feature: NA.44.78.H01.1.454.heavy.2.nb
tgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttggtggggccagggaccctggtcaccgtctcctcacgccctccaccgaacgggcccagtccggtccttcccccgtggccgccctgccctccgaggacgccaccctccgagacgcacagcggccctgggctgcctggtcaaggactacttcctatatctgt

SEQ ID NO: 443688 - DNA, 483 bp, Homo sapiens
  misc_feature: NA.44.78.H01.2.454.heavy.2.nb
tgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttcgtgcgagacgccaccagcacctggcttgacttgtcggggccagggaaccctggtccaccgtctcctcacgccctccaccgaagggccccagtcccggtccttcccccgtggccgccctgctccgacggacgccacctccgagacgccacacgccggccctggggcctgcctggtcaaggactacttcctatatctgt

SEQ ID NO: 443689 - DNA, 480 bp, Homo sapiens
  misc_feature: NA.44.78.H01.3.454.heavy.2.nb
tgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttcgtgcgagacgccaccagcacctggcttgacttgtcggggccagggaaccctggtccaccgtctcctcacgccctccaccgaagggccccagtcccggtccttcccccgtggccgccctgctccgacggacgccaccctccgaagacgcacagcggccctgggctgcctggtcaaggactacttcctatatctgt

SEQ ID NO: 443690 - DNA, 371 bp, Homo sapiens
  misc_feature: NA.44.78.H01.6.454.heavy.2.nb
gagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccccaggctccgagggagggctggagtgggtgccgtatagaaccaaagctgacggtggacagcagactacgctgccacccgtgaaagcagattcaccatctacaagagatgattacaaaagatacggtgt

SEQ ID NO: 443691 - DNA, 234 bp, Homo sapiens
  misc_feature: NA.44.79.H02.1.454.heavy.2.nb
gtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggatccgttctgagtacttccaagattggggccagggcaccctggtcaccgtcgcctcagcctccacca

SEQ ID NO: 443692 - DNA, 369 bp, Homo sapiens
  misc_feature: NA.44.84.H07.1.454.heavy.2.nb
aggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattggcacagccgtggggggtccctgagactctcctgtgcagcctctggcttccccttaggagctatgccatcgaccgtgggtcccgccaggcctccgaggggaaggggctcggaggtgggtctcggacaattggcgctagtcgcaactgacacatactacggagagtcccgtgaaggggccgcttcaccatctccagagacaattccggaaac

SEQ ID NO: 443693 - DNA, 378 bp, Homo sapiens
  misc_feature: NA.44.85.H08.1.454.heavy.2.nb
aggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccagccgtgggagtccctgagactctcctgtgcagcgtctggattcaccttcagtacctatggcatgcacgtgggtcccccaggcctccaggcgaaggggctgggagtgggtgccacttatagtggtatgatgggaaataataaatctatgacagactcgtagaacgggcatcacatctccagagacaaataccaaagaacacgctagtatctgacaaa

SEQ ID NO: 443694 - DNA, 453 bp, Homo sapiens
  misc_feature: NA.44.86.H09.1.454.heavy.2.nb
ctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaatggagtggattggtgacatccattatactggggcgacgtactactctccgtccccctcaagagtcgtctcaccttttcgagggacacgtccatcgaaaccgcttctccctgaaactgaccctccgtcgaccgccgcgacacggtccgtttattctgtgcgtaggcgagactggtctttcaatctagtggggccgtggcacccgtggtcactcgtcctcgagcttccac

SEQ ID NO: 443695 - DNA, 430 bp, Homo sapiens
  misc_feature: NA.44.86.H09.2.454.heavy.2.nb
gagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagactctcctgtgtagcgtctggattcaccttcaacagacatggcatgcacgtgggtccgccaggcctccgaggcaaaggggctgggagtggggtgcacttatatggtatgatggaaagtaataatattatgtagattccgtagaagggccattcaccatctccagagacaattcgaagaacacactatatctaggaaatgaatagctagagagccgaggacacggctgtctactactgtagcgagaa

SEQ ID NO: 443696 - DNA, 287 bp, Homo sapiens
  misc_feature: NA.44.9.A09.2.454.heavy.2.nb
  modified_base (230)..(230): a, c, t, g, unknown or other
cactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcacgtgggtcccnccaggcctccgaggcgaaggggctgggagtggggtgactaagttatatccaagaaga

SEQ ID NO: 443697 - DNA, 354 bp, Homo sapiens
  misc_feature: NA.45.14.B03.1.454.heavy.2.nb
cctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcgggacggtagtgggacgtcgtgggggaccaaagggaccacggtcaccgtctcctcagccctccacc

SEQ ID NO: 443698 - DNA, 418 bp, Homo sapiens
  misc_feature: NA.45.26.C04.1.454.heavy.2.nb
accagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggacttgagtggatgggaagatgcttctatcttaatacaagagacctacgcacagatcttccgggcagactctccattaccgcggacagtccacgagtacagcctacatggatctgaccagcctcacatcctagaacgacacggtccgtttatactgtggcggggtaatttcttcgtacttactt

SEQ ID NO: 443699 - DNA, 545 bp, Homo sapiens
  misc_feature: NA.45.34.D01.1.454.heavy.2.nb
aggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccatccgggggggtccctgagactctcctgtacagcctctggactcaccttgagcaattattggatgacctgggtccgccaggctccgagggaaggggctggagtgggtggccaaacataaagcaagatgggagtcgaaaagaactatgtggactctgtgaagggtcggttcaccatctccagagacaatgccaagaattcagttcttttaggaaatggacagtctgagatccgaagatacggcagtatattactgcgcgagagatgatagtctaagtgggggtagagacatctggtttgatgctttcgatgtgtggggccacggggacaacggtcaccgtctctcagccctcacaaggccatcggtctcccctgcgccctgctc

SEQ ID NO: 443700 - DNA, 481 bp, Homo sapiens
  misc_feature: NA.45.36.D03.1.454.heavy.2.nb
ggaagaggaagactgacggtcctcccaggagttcaggtgctgggcaccttgggcacgggggaggtgtgtcacaagatttgggctctgggcaccgtgggcagtgggggagcgttgtccagcctgggaggtccctgagactctcctgtgcagcctctggattctccctcagtaactttggtttccactgggtccgccaggttccaggcaaggggctggagtgggtggccctatttccgaagatggaagtgagaaggcctactcagactccgtgaaggccgcttcaccatctccagagacaattccaagaatgtcctcttttgctaaatgaatagcctgagagttgaggacacgtctgtctatttctgtgccgagggggacatctatgagtctggttcgtagtgtaatcaactactactacctcatggacgtctgggacaaagggacctcggtcaccgtctccgcagcttccaccaagggccca

SEQ ID NO: 443701 - DNA, 437 bp, Homo sapiens
  misc_feature: NA.45.36.D03.2.454.heavy.2.nb
ggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctcttttgcaaatgaatagcctgagagttgaggacacgtctgtctatttctgtgccgagggggacatctatgagtctggttcgtagtgtaatcaactactactacctcatggacgtctgggacaaagggacctcggtcaccgtctccgcagcttccaccaagggccca

SEQ ID NO: 443702 - DNA, 426 bp, Homo sapiens
  misc_feature: NA.45.37.D04.1.454.heavy.2.nb
cacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacaggcccctggacaagggcttgagtggatgggatggatcaacccctaacaatggtggcacaaactatgcacagtaagtttcagggcagggtcaccatgacagggacacgtcatcagcacagcctacatggagctgagcagactgacatctcgacgacacggccatttactactgtgcgaggattcggtttaccggtgg

SEQ ID NO: 443703 - DNA, 356 bp, Homo sapiens
  misc_feature: NA.45.37.D04.2.454.heavy.2.nb
cacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacaggcccctggacaagggcttgagtggatgggatggatccaaaccccctaacaagtggtggacaacaaactatgacacagtaagtttcgagggcagggtcaccagtcgaccgagggaccacgtccatc

SEQ ID NO: 443704 - DNA, 371 bp, Homo sapiens
  misc_feature: NA.45.38.D05.3.454.heavy.2.nb
tgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaagtttgggctgggtccgccagcccccaggggaacgggctggagtggattgggactgtctactctagtgggaccactattacacgcccgtccctcaagacctcgactggtgatctacaataaaccacgtaccaaagaaccaattcctccctgacgctgaactctgtgaccgcgcggacacggacc

SEQ ID NO: 443705 - DNA, 441 bp, Homo sapiens
  misc_feature: NA.45.39.D06.1.454.heavy.2.nb
gagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggagtccctgacactctcctgtgaagcgcctggactcaccttcagtggctatggccttcactgggtcccgccaggttcccaggcaaggggctgggagtggttggctgatatatggtatgatggagagactaaacctttgcagactccgtgaggggcgatcacatcgccagagacaatccagaacacattgtatctggcaatgaacaacctgacgacccgaggacgacgggtgtatattctgcgcgagagaagtgggggttctacgttgg

SEQ ID NO: 443706 - DNA, 414 bp, Homo sapiens
  misc_feature: NA.45.40.D07.1.454.heavy.2.nb
tcctgaggactgtaggacagccggagtgggttgcaggcatcagccctggtggtcctcccatctactacgcagattttgtgatgggccgattcgccatctccagagacaatgccaagaactccctgcttctgcaacttaatgccctgagagacgaggactcggcttctttacttctgtgccgtaggggttatagtcgcgcggctcctctccggtctttgatctcgtggggccaagggacaagggtcaccgtctcttcacgccctccaccgaacgggcccatccggtccttcccccccgtggccgccctgcctccgaggcgccaccctccgagacgcacgacggccggcccgtggggcctcggcccgttgggtaccaaacgggtccttaccgttcccgtacgtacttccggccgtt

SEQ ID NO: 443707 - DNA, 347 bp, Homo sapiens
  misc_feature: NA.45.42.D09.1.454.heavy.2.nb
gagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagccgtgggaggtccctgagactctcctgtgcagcctctggattcaccttcagctactatggcatgcacgtgggtcccccaggcctccgaggcgaaggggtctggggagggggtgctacgttatatcatatgatggtaaactttataagtactatccaagtactccgtaggaacgggccgattcac

SEQ ID NO: 443708 - DNA, 444 bp, Homo sapiens
  misc_feature: NA.45.49.E05.1.454.heavy.2.nb
gagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgactattggatgacctgggtccgccaggctccgaggggaaggggctgggagtgggtggccaacgtgagagtgggatgggaggtagtgtctactatgtggactctctggaagggccgattcaccatctccagagacaacgccaaagaactcactgtatctgacaaatcgaccagcctgagagtcgaggacacggctgtctactactgtcgacgaccataatcatc

SEQ ID NO: 443709 - DNA, 416 bp, Homo sapiens
  misc_feature: NA.45.5.A05.2.454.heavy.2.nb
gagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgtttaggttctggattcgtcttcagcgactactacctgagttgggccgctggctccgagggaagtctggagtggattgcgtacatcagtcattctgacttcgaccgtctactacgcagctctggtggagggccgtattccacctattccagggacgacgcgcgaactcactttatctgcagatgactagtctgacgacccgaagacacggccatatattactgtgc

SEQ ID NO: 443710 - DNA, 400 bp, Homo sapiens
  misc_feature: NA.45.51.E07.1.454.heavy.2.nb
caaccacattcctcctctaaagaagcccctgggagaacagctcatcaccatggactggacctggaggctcctctttgtggtggcagcagctacaggcggccagtcccaggtccagttggtgcaatctgggtctgaaatgaagaagcctgggtcctcggtgaaggtctcctgtagggcttctggaggctccttcagcagctacagtgtgacttgggtgcgacaggcccctggacaagggcttgagtggctgggaaagatcatccctgagtacgggctagtacgactacgcacagaaagttccaagggcagactcacgattaccgcgacaaatcgacgagcaccgccttcatggaactagcagcctaggaagtctagaagacacggcctatattactgtgcg

SEQ ID NO: 443711 - DNA, 429 bp, Homo sapiens
  misc_feature: NA.45.53.E09.1.454.heavy.2.nb
accacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtcgccaggcccccggacaagggcttgagtggatgggatggatcaacgctggcactggttacacagaatatcacagaaattccaggacagagtcacctatttctagggacatattcgacgaacacagcctacatggacctgagcaagtttgagtatcgtagacgacgacggctgtctattactgtgcgagaggacggggggaggtagtagttgcaacgtaa

SEQ ID NO: 443712 - DNA, 595 bp, Homo sapiens
  misc_feature: NA.45.60.F05.1.454.heavy.2.nb
ggtcctgccacaggtggtgctgggcacggtgggcactcgacacagaccaccaaccatggagtttgggcttagctgggttttccttgttgctattttaaaaggtgtccaatgtgaagtgcagctggtggagtcgtgggggagacttggtacagccagggcggtccctgagagtctcctgtatagcttctggattcacctttggtgtattatactatgacctgggtccgccaggctccgagggaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactagaggggtaggtcgctgtccggtaactcccactactggggccaggggaaccctggtcaccgtctcctcagcctccaccaagggccccatcggtcttccccctggccgccctgctccaggacgccacctccgagagcacagccggccctgggctgcctggtcaggctacttcctcgatcgcgt

SEQ ID NO: 443713 - DNA, 421 bp, Homo sapiens
  misc_feature: NA.45.63.F08.1.454.heavy.2.nb
ccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttccccttcaatagctatagcatgaactgggtccgccaggctccgagggaggggctggcgtgggtttcatacattagtactagtagtagtacccatatactacgcagactctgtgaagggccgattcaccatctccagagacaatgaccaaagaactcactgtatctgacaaatgaacagcctagagagacgaggacacggctagtatattactgtgacgagtagt

SEQ ID NO: 443714 - DNA, 381 bp, Homo sapiens
  misc_feature: NA.45.69.G03.1.454.heavy.2.nb
  modified_base (313)..(313): a, c, t, g, unknown or other
aaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtgcgacacggccccgggaaaggcttgagtggataggatggatcgagcgacaaacatggtagacacacactatgacacagaagttccggggcagagtcctnttgaccactgacacatcacgaggacagcctacttggagtgatgagcctgacagtcacgacgacacggc

SEQ ID NO: 443715 - DNA, 601 bp, Homo sapiens
  misc_feature: NA.45.72.G06.1.454.heavy.2.nb
gcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccagggaaggcctggaatggattggctttgtctattatactggggtcaccaattacaacccctccctcaagagtcgggtcaccatttcggtcgacacgtccaacagcctgttctccctgaaggtgcattctgtgaccgctgcggactcggccgtgtattactgtgcgagaatcgatgagagtgctggttattactatggttactttgactcgtggggccagggacgcccgtggtcaccgtctcctcagcttccaccaagggcccatccggtccttccccctggcccgcccctgcctccaggacgccacccgtcgtcggggggccacgacggccccgggcccgtggggcctcggacccgttgggtaccaacgggtaccttaaccctttcccg

SEQ ID NO: 443716 - DNA, 513 bp, Homo sapiens
  misc_feature: NA.45.75.G09.2.454.heavy.2.nb
gcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccaggccgggggggtccctcagactctcgtgtgcagcctctggattcaccgtcagtggcagcttcctgagctgggtccgccaggctccgaggggaagggcctggagtgggtctcagttaatttttagacaggcacagcgtactacgcagattccgttaagggccattcaccatctccagagacaattccaggaacacggtgtttctgaaatgaacaccctgagacccgaggacacggctctatattactgtgcgagagatcgaaacccagaccccggaagaaacttcaacaactactacggtatcggacgtctggggccaagggaccccaccgtcaccgtctcctcacgccctcc

SEQ ID NO: 443717 - DNA, 611 bp, Homo sapiens
  misc_feature: NA.45.78.H01.1.454.heavy.2.nb
cccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaattacgatttttggagttggttatcggacggtatgggacgtcgtggggccaaggggaccacggtcaccgtctcctcagcctccaccaacgggcccatcggtccttccccctggccaccctcctccaacgacgccaccctcgtcgggggcacgacgccggccctgggctgcctggtcaaggctactcctcgaatcgcgt

SEQ ID NO: 443718 - DNA, 338 bp, Homo sapiens
  misc_feature: NA.45.79.H02.2.454.heavy.2.nb
attgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtaggggatttttgatatctggggccaagggacaatggtcaccgtctcttcagcctccaccaaggcccatcggtcttccccctggccaccctcctccaagagcacctcgtgggggcacagcggccctgggctgcctggtcaaggactacttcctcgatcgcgt

SEQ ID NO: 443719 - DNA, 353 bp, Homo sapiens
  misc_feature: NA.45.80.H03.2.454.heavy.2.nb
gacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtctgggggagcgtggtccagccgtgggagtccctgagactctcctgtgaagtcagtggattcaacttcaagtaactatgaccatacagttcgggtccgccaggctccgaggcgaaggggctggagtggctgtcagttattacgaaaaaaggtaataacataatattatagagactcattaagggccattacaccctaatcctaccagac

SEQ ID NO: 443720 - DNA, 448 bp, Homo sapiens
  misc_feature: NA.45.84.H07.1.454.heavy.2.nb
aggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagtatttatagtgtgaaatgggtccgccaggctccgagggaaggggctgggagtgggtctcatccattagcagtagcagtggtcacatatattacgcagactcagtgaagggccgcttcaacatctccagacgacaacgaccaaagaactcactgtactctaacaaatgaaacagtctagagagccgaggacacgggtctagtttacactgtacgaagacagagctaagtaaggc

SEQ ID NO: 443721 - DNA, 368 bp, Homo sapiens
  misc_feature: NA.4.10.A10.2.454.heavy.2.nb
tgtgcagcctctggattcaccttcacctcgtatagcatgacctgggtccgccaggctccagggaaggggctggagtgggtctcatccattggtactggtagtccttacatatactacttagactcagtgaggggccattctccatctccagagacgactccaagaactcagtgtatctgcacatggacagcctgagagccgaggacacggctgtgtatttcgtggtgggaggtcgtcggtggtgctggagaaacggcgttgacttcgtcggggccagggaccctggtcaaccgtctcctcacgccctaccaccgaacgggcccagtccggtccttcccccgtggccgccctgcctccgaggcgccacc

SEQ ID NO: 443722 - DNA, 431 bp, Homo sapiens
  misc_feature: NA.4.12.B01.1.454.heavy.2.nb
catgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccggcacgtccccaacacagggactgcagtggattggatacatctacttcagtggaaccccaactaccaacccctcctcaggagtccagtcgccatatccctggactcgtccaacaaccccagatctccctgaaccgatcgacatctgtcgaccgctgcgacacagtccgtttatactgtcgcgcgatcgtgggcgactcgagtgactagtggtatggacgtcgtggggccaagggaccacgggtcagtcgtctcctcacgcct

SEQ ID NO: 443723 - DNA, 389 bp, Homo sapiens
  misc_feature: NA.4.19.B08.1.454.heavy.2.nb
  modified_base (213)..(213): a, c, t, g, unknown or other
  modified_base (274)..(274): a, c, t, g, unknown or other
agcactggaagtcgccggtgtttccattcggtgatcagcactgaacacagaggactcaccatggagtttgggctgagctgggtcttcctcgttgttcttttaagaggtgtccagtgtcaggtgaaattggtggactcgtgggggaggcgtggtccagcctgggagtccctgagactctcctgtatagcctctggattcaccttcggcagttangctatgcactgggtccccaggcctccaggcaaggggttgagtgggtgcagcaatatcatangatggaatgaataaatattacatagagtccgtgaagggtcattcacatctacagagacaatcgacaaagaacacactgtaatctaggaaatgaaccagcctagagaggtgacgac

SEQ ID NO: 443724 - DNA, 408 bp, Homo sapiens
  misc_feature: NA.4.21.B10.1.454.heavy.2.nb
  modified_base (358)..(358): a, c, t, g, unknown or other
  modified_base (371)..(371): a, c, t, g, unknown or other
actctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgcttgtttttaggaaatgaacagcctagaaaaccgaggacacagtccgtttattctgttccacactccctgcctacagagtatttcgtgactataatcgcatatggacgtctggggccaaaggggaccacagtcaccgtctcctcaacctccacaaggcccatcgctcccctgccncctgctccaggancacctccgagagcacacgcggccctgggctgccctgg

SEQ ID NO: 443725 - DNA, 562 bp, Homo sapiens
  misc_feature: NA.4.22.B11.1.454.heavy.2.nb
agccccagccgtgagattcccaggagtttccacttggtgatcagcactgaacacagaccaccaaccatggagtttgggcttagctgggttttccttgttgctattttcaaaggtgtccaatgtgaggtgcaactgctggagtcgtgggggagcttgggtacagccgagggcgctccctgacactctcctgtacaacttctggttcatcttgctgattatactttgacctggtcccaggctccgaggggagggctggagtggattggtttcattagaagcaaaacttatggtgggacaccagaatatgccgcgtctgtgaaaggcagattcaccatctcaagagatgattccaaaagtgtcgcctacctccagatgactagcctgaagaccgaagactcagtccctttattactgtgctagagatcgactggcccgttagtatttttggcgtcggccccgacggacatcctcagactcctggggtcagggaaccctggtcaccgtctcctcagcctccaccaacgggcccatccggtcttccccctggccaccctcctcccca

SEQ ID NO: 443726 - DNA, 435 bp, Homo sapiens
  misc_feature: NA.4.23.C01.1.454.heavy.2.nb
accacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttaacaatgggaaacacaaactatcgcacagacgttccagggcagagtcaccataccacagacacatccacgagcacagcctacatggacctgaggagcctgagatttgacgacacggccatatattactgtgcgagagagttgggaccgacggaaaccttgactaacgtgggg

SEQ ID NO: 443727 - DNA, 485 bp, Homo sapiens
  misc_feature: NA.4.25.C03.1.454.heavy.2.nb
aggagcccagcactagaagtcggcggtgtttccattcggtgatcagcactgaacacagaggactcaccatggagtttgggctgagcttgggttttcctcgttgctcttttaagaggtgtccagtgtcacgtgcgcctggtggagtctgggggagcgttgtccagcctgggaggtccctgagactctcctgtgcagcgtctgcattcaccttcaggagctatgggatgcactgggtccaccaggctccaggcaaggggctgggagtgggtgctacttagttggtatgatggaaagtaagaaatactatgcagagtccgtagaagggccgattcacatctcagagacaattccaacaacacgctgttcctgacaaatgaacagcctgagagccgaggacacggctgtgtatcactgtgtcagagatgccgagggccggttacccctgttcggttccttcgactagttatggtatggacgtcgtgggg

SEQ ID NO: 443728 - DNA, 553 bp, Homo sapiens
  misc_feature: NA.4.26.C04.1.454.heavy.2.nb
gagaggagcccagccctgggattttcaggtgttttcatttggtgatcaggactgaacagagagaactcaccatggagtttgggctgagcgtgcgttttctagtggctattttaaaaggtgtccagtgtgaggtgcagttggtggagtctgggggaggcttggtacagccgtgggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccattcaccatctccagagacaattccaagaacacgttatatctgacaaatgaacagcctgcgagccgacgacacggccgtatattactgtgacgaaatgccttattgcgaccgagcgtagcagtggctggtgcaactggctccgaccccgtggggccagggaacccagtcgtcaccgtctcctcacgccctccaccaacgggcccagtcggttcccttcccccg

SEQ ID NO: 443729 - DNA, 565 bp, Homo sapiens
  misc_feature: NA.4.28.C06.1.454.heavy.2.nb
cctgggattcccagctgtttctgcttgctgatcaggactgcacacagagaactcaccatggaatttgggctgagctgggttttccttgttgctattttaaaaggtgtccagtgtgaggtgctcctggtggaggtccgggggagcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatcgtaggaaatgagcagtctgagagccgaggacacggctgtgtattactgtgcaaagagataacggaccttggtacgccctttgactaacgtcgggggcccggggacctgggtccaccgtctccgtcggccctccaccaacgggcccagtccggtccttccccctggccgccctgcctccagcgcaccgtccgagacgcacgagccggccct

SEQ ID NO: 443730 - DNA, 287 bp, Homo sapiens
  misc_feature: NA.4.29.C07.1.454.heavy.2.nb
gttggccatattaaaagcaaatctgatggtgggacaatacactacgctgcacccgtgaaaggcagattcaccatctcaagagacacttcaagaaattcattgtatctgcaaatgaacagtttgaaaaccgaggacacagccgtgtattatgtacagctggacactattctccctggggccagggaaccctggtcaccgtctcctcagcctccaccaagggcccatccggtccttccccctggccgccctgctccaggagcacctccgagacgcacagcggccctggg

SEQ ID NO: 443731 - DNA, 344 bp, Homo sapiens
  misc_feature: NA.4.30.C08.1.454.heavy.2.nb
aggagccttagccctggactccaaggcctttccacttggtgatcagcactgagcacagaggactcaccatggaattggggctgagcttgggttttccttgttgcttattttagaaggtgtccagtgcgaggtgcagctggtggagtcgtgggggagtcttggtccagccggtgggggtccctgagactctcctgtgcagcctctggattcacctttactacctattggatggactgggtccgccaggctccgaggggaaggggctgggagtgggtggaccaaacaataaaaccaagataggaagtgaacagtactagtgtggactctggtagaagggccgattc

SEQ ID NO: 443732 - DNA, 426 bp, Homo sapiens
  misc_feature: NA.4.33.C11.2.454.heavy.2.nb
gagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggagcttggtccagccagggcggtccctgagactctcctgtacagcgtctggattcaactttcgtgattatgccatgaactgggtccgccaggctccgaggggaagggctggagtgggtaggtttcattagagccatggcttagtgctgggacaacagaatacgccgcgtctgtgaaaggcagattcatcatctacaagagatgattccaaacggcatcgcctatctgcagatgaacagcctagaagaccgaggacacagccgtactattac

SEQ ID NO: 443733 - DNA, 379 bp, Homo sapiens
  misc_feature: NA.4.34.D01.3.454.heavy.2.nb
aagactgacggtccccccaggagttcaggtgctgggcacggtgggcatgtgtgagttttgtcacaagatttgggctcaactttcttgtccctaagactctcctgtgcagcctctggattcacctttagtacctatgccatgggctgggtccgccaggctccgtgggaaggcctggcgtgggtctcaggaattagtactagcggtggccatacatactacgcagattccgtgaagggccgattcaccatctccaggacaactccaagaacacgctgtatctgacaaatcgaacagcctagagagccgaggacacggtccgtttattctgtgacgaaagtcccggggtagggggggtagttagttagtacgtgccgtagtt

SEQ ID NO: 443734 - DNA, 410 bp, Homo sapiens
  misc_feature: NA.4.35.D02.1.454.heavy.2.nb
actttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtgctcatcagtaattgactggagctggatccggcagtcccgaagggaagggactggagtgggtggatatatctttcacaccgggaccaccaactacaactccctccctacaagagtcgactcaccatgtcactggacacttccaaagaaccagttacctaccctaaaattcgaacctctgtgagcgctgcagacacggccgtctattactgtgcgagactggcggggctagttagtgggtt

SEQ ID NO: 443735 - DNA, 585 bp, Homo sapiens
  misc_feature: NA.4.36.D03.1.454.heavy.2.nb
tccagctttcactgtgatcagcactgagcacaggaggacgtcaccatggaatttggggtcgtgtagctggggttttccgtttgtttgtctattttagtaaggtgtccagtgtgaggggcgattggtggaggtctggggagggcttggtccagcctggggggtcccgtgagactctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttcctccccggacactgcggtggcagggtatgatgcatttgatatcgtggggccaaaggggacaagtggtcaccgtctcttcagcctccaccaagggcccatcggtcttccccctggccgccctgcctccgaggacgccacctccgagacgcacacgccggccctggggcctcg

SEQ ID NO: 443736 - DNA, 399 bp, Homo sapiens
  misc_feature: NA.4.37.D04.1.454.heavy.2.nb
acccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactggcccctggacaagggcttgagtggagtgggatggctccgacctaaagcggtggcacaaagtatgcacagaagtttcagggcagggtcaccatgaccagggacacgtccatcagcacgtccatcagcacagcctacatggacctgagcggcctggacagtctcgacgac

SEQ ID NO: 443737 - DNA, 299 bp, Homo sapiens
  misc_feature: NA.4.37.D04.2.454.heavy.2.nb
acccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactggcccctggacaagggcttgagtggagtgggatggctccgacctaagaggcggtggacaacgaaagtat

SEQ ID NO: 443738 - DNA, 159 bp, Homo sapiens
  misc_feature: NA.4.37.D04.3.454.heavy.2.nb
agactgacggtcctcccaggagttcaggtgctgggcaccgtgggcagtgggggaggcgtggtccagcctggggggtccctgagactctcctgtgcagcgtctggattcgccttcagtgcctatggcatgcacgtgggtccgccaggctccaggcaaggg

SEQ ID NO: 443739 - DNA, 461 bp, Homo sapiens
  misc_feature: NA.4.39.D06.1.454.heavy.2.nb
  modified_base (436)..(436): a, c, t, g, unknown or other
  modified_base (450)..(450): a, c, t, g, unknown or other
ggagaggagccccagccctgagattcccacgtgtttccattcagtgatcagcactgaacacagaggactcgccatggagtttgggctgagctgggttttccttgttgctatttaaaggtgtccaatgtgaggtgcaactggtggagtctgggggaagtgtggtacggcctgggggtccctgagactctcctgtacagcctctggattctcctttgatgattatggcatgagctgggtccgccaagctccgagggaagggctggagtgggtgtctggtatgaattggagtggcggtagtacagcttatgcagactctgtgaagggccattcaccatctccagagacaacgccaaagaactccctgtatctgacaattgaacagtctgagagccgaggacacggcctttgtattactgtgcgagaactagtttagggntgtagtggtaaacngctgcttagtt

SEQ ID NO: 443740 - DNA, 241 bp, Homo sapiens
  misc_feature: NA.4.53.E09.1.454.heavy.2.nb
  modified_base (230)..(230): a, c, t, g, unknown or other
agactctcctgtacagtctctgcatctaccttcactttctttttggatgacctggctccgccgggctccgagggaggggctggagtgggtggccaccatcaatcaagatggaagtgagagaacctatgtggactctgtgaaggccattcaccatctcagagacaacgcaaagaattctctgtatctgacaaatgaacagccgagagccgaggactcggctgtctattacngtgacgaggaa

SEQ ID NO: 443741 - DNA, 578 bp, Homo sapiens
  misc_feature: NA.4.57.F02.1.454.heavy.2.nb
ggagcccaccagcactagaagtcggcggtgtttccattcggtgatcaccactgaacacagaggactcaccatggagtttgggctgagctgggttttcctcgttgctcttttaagaggagtcaggtgtctgggcacctggtggagtcgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaatttcgagaacacattgaatctacagatgaacagtctgagagccgaggacacggctgtctattattgtgcgagagtaagtggtcatggtccttttagaccgtggggccagggaaccctggtcaccgtctcctcagcttccaccaacgggcccatccggtcttcccctggccgcccgtcgcctccgaggacgccacctcgtcgggggccacgacgccggcccgtcggggctcggc

SEQ ID NO: 443742 - DNA, 390 bp, Homo sapiens
  misc_feature: NA.4.58.F03.1.454.heavy.2.nb
accacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccaggcccccggaaaagccttgagtggatgggatcgatcaactctggcaatggacaaacacaaaatacttacacagaaagttacagggcaagagtcaccataccagggacacatccgacgaacacagcctacatggagctgagcagcctgacatctagaagacacggctgtgtatt

SEQ ID NO: 443743 - DNA, 452 bp, Homo sapiens
  misc_feature: NA.4.59.F04.1.454.heavy.2.nb
actttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactcataagtgtttctctggagctggatccggcacgcccccgagggaaggactggagtggattggccatatctcttacagtgggagcaccaactacaacccctccctcaagacgtcgtgtcaccgtgtcaatgacacgtccaagaaccagttctccctgaggctgagctctgtgaccgccgcggacacggccgtgtatttctgtgcgagatctttcgatttttggagtcggtaacccccttggctacgtggggccagggaaccctggtcaccgtctcttca

SEQ ID NO: 443744 - DNA, 417 bp, Homo sapiens
  misc_feature: NA.4.6.A06.2.454.heavy.2.nb
aagacctcggagaccctgtccctcacttgcactgtctctggtggctccatcagcagtttctatggggcttggatccggcagcccccagggaagggactggaatggattgggaacacctattacagtgggagccccagctacaatccctcctcaagagtcgactcaccatctcggctgacccgtcaagaatcagttctccctgaggctgacctctgtgaccgccgctgacacggccgtctattactgtgggagacagtgcagtggtggttcgtgccccccgagtacgtggggccgcggaatcttgggtcaccgtctcctcagcctccaccaacgggcccatcggtcttccccctggccgccctgctccaggacgccaccgtccgagacgcacacgccggccctgggctggccctggtc

SEQ ID NO: 443745 - DNA, 334 bp, Homo sapiens
  misc_feature: NA.4.60.F05.1.454.heavy.2.nb
tccccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactacgtggggccagggaccctggtcaccgtctcctcagcctccaccaagggcccatcggtcttccccctggcgccctgctcccaggacgccacctccgagagccacagccggccctgggctgcctggtcaaggcctaccttccc

SEQ ID NO: 443746 - DNA, 401 bp, Homo sapiens
  misc_feature: NA.4.66.F11.1.454.heavy.2.nb
  modified_base (319)..(319): a, c, t, g, unknown or other
gccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagccgtgggggtcccttagactctcctgtgcagcctctggattcaccttcagtgacgactggatgaattggatccgcaggctccgagggagggctggaggtgggtcggcatattaacgacccaaaatgaacggtaggggaaacagacctacgctgcacccgtgagnggcagattcaccatttcaagagatgattacaaaaagtacactgtatactaggaaatgaaacagcctagagaatacgacgaca

SEQ ID NO: 443747 - DNA, 323 bp, Homo sapiens
  misc_feature: NA.4.67.G01.1.454.heavy.2.nb
aggagcccagccctgggattttcaggtgttttcatttggtgatcaggactgaacagagagaactcaccatggagtttgggctgagctggctttttctgtggctattttaaaaggtgtccagtgtgaagtgcagctggtggagtcgtgggggaggcctggcacgaggccggggggtccctgagactctcctgtgcagcctctggattcagttttagaatgtctgccatgacctgggtccccaggctccgtggggaaggggctgggagtggatcgtcgaggggattaggcggcacgtggacgtattataactattaattaactaa

SEQ ID NO: 443748 - DNA, 394 bp, Homo sapiens
  misc_feature: NA.4.7.A07.1.454.heavy.2.nb
cagccctgggattttcaggtgttttcatttggtgatcaggactgaacagagagaactcaccatggagtctgggctgagctggcttttcttgtggctattttaaaaggtgtccagtgtgaggtgcagctggtggagtcgtgggggaggcttggtacagccgtgggggtccctgagactctcctgtgcagcctctggattcatcttagcagctatgccatgagctgggtccgccaggctccgaggggaaggggctggaatggggtctcgatcctattagtgctactactggtggcacatacttcgcagactccgtgaacgggccgttctccatctccagagacattccaaagaacacgctgtatctagcaattgaacagcctgacgagccgaggac

SEQ ID NO: 443749 - DNA, 460 bp, Homo sapiens
  misc_feature: NA.4.71.G05.1.454.heavy.2.nb
tgggcccttggtggaggcttggtgaagccggggggtcccttagactctcctgtgcagtctctggactcaacctcaaaaatgcctggatgacctgggtccgccagactccagggaagggctgcagtgggttgccgtattataaccaaacctgatggtgagacaacagactacgctgcacccgtgaaaggcagattcaccatctcaagagatgattcaacgaacacgctgttttaggaaatgaacagcctagaaaaccgaggacacagccgtttattctgttccacactcctgcctacagagtatttcggactataaatcgccatatggacgtcgtggggaccaagggaccaagtcaccgtctcctcaacctccaaccgaacgggcccaagtcggtccttcccccgtggccgccctgcctccaggacgccacctccgagacgccacgacgccggcccctggg

SEQ ID NO: 443750 - DNA, 450 bp, Homo sapiens
  misc_feature: NA.4.75.G09.3.454.heavy.2.nb
gccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacagctcaccatcaacccaaggaccgaccctaccaaaaaccggtacggtaccttaacaatacgaaccaaacatcggaccctgtggacacagccacatattactgtgcacagagatacgggcagcacggtggtttggggctacgtggggccagggaccctggtcaccgtctcctcacgcctcaaccg

SEQ ID NO: 443751 - DNA, 342 bp, Homo sapiens
  misc_feature: NA.4.77.G11.1.454.heavy.2.nb
gctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttaggttttgacagtgggacagggaaccctggtcaccgtctcctcggcctccaccaagggccccatccggtcttccccctggccgccctgcctccaggacgcacctccccgagagcacagccggccctgggctgcctggtcaaggctacttccctacagtgct

SEQ ID NO: 443752 - DNA, 303 bp, Homo sapiens
  misc_feature: NA.4.79.H02.1.454.heavy.2.nb
  modified_base (298)..(298): a, c, t, g, unknown or other
tttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggtagtttgatgctagcgagggcctactatgactacgtggggccagggaaccaaggtcaccgtctcctcagcctccaccaacgggcccatcggtcttccccctggcgccctgctccaggacgcacctccgagacgcacncggcc

SEQ ID NO: 443753 - DNA, 409 bp, Homo sapiens
  misc_feature: NA.4.81.H04.1.454.heavy.2.nb
  modified_base (370)..(370): a, c, t, g, unknown or other
ggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaaccgtggggggtccctgagactctcgtgtgtagtctctgaattcatcttcagggactttgacatgaattgggtccgccaggctccgaggggaaggggctgggagtgggtctcatccatcagttccagtactcgttacatatactaacgcagactcagtgaggggccattcaccatctccagagacaacgccaaagactcagtgtttcngacaaatgaacagcctgagagtcgaggactcggctgtct

SEQ ID NO: 443754 - DNA, 341 bp, Homo sapiens
  misc_feature: NA.4.82.H05.2.454.heavy.2.nb
  modified_base (272)..(272): a, c, t, g, unknown or other
cagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagccgtggggcctcagtgatggtctctgcaaggcttcgtggattcaccttcaccggctactatttgcacgtgggtgcgacacggcccctggacaagggcttgagtggatgggatggatcaacctantacgtggtgccacacactatgcacagtactttcgtgggcagggtcaccatgaccagggacacgtccatc

SEQ ID NO: 443755 - DNA, 402 bp, Homo sapiens
  misc_feature: NA.4.9.A09.1.454.heavy.2.nb
ccctgggattttcaggtgttttcatttggtgatcaggactgaacagagagaactcaccatggagtttgggctgagctggtcttttcttgtggctattttaaaaggtgtccagtgtgaggtgcagttggtggagtcgtgggggaggcttggtacagccgtgggggtccctgagactctcctgtacagactctggattcacctttagcagccatgccatgagctgggtccgccaggctccgaggggaaggggctggagtgggtctcgagcaagttagtggaggtggtggtggtggtacatactacgcaactccgtgacggggccgattcaccatctccagagacaattccaaagaacacgttatatctgacaaatgaacagcctgcgagccgacgactacggcc

SEQ ID NO: 443756 - DNA, 459 bp, Homo sapiens
  misc_feature: NA.51.26.C04.2.454.heavy.2.nb
gttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtgctgttataacttctgatggaggtacaacatattactcagacgccgtgaggggccgattcaccatctccagagacaattccgggaacacactgtctctgacaaatgaacagcctgagagctgagacagggctgtttatactgtgtgcgatccgacctcactggtacggggagttacttcctcgcaacggtatgggtacgtcgtggggccaagggaccacggtcaccgtctccttacgcctccacacgggcccagtcggtccttcccccgtggccaaccc

SEQ ID NO: 443757 - DNA, 301 bp, Homo sapiens
  misc_feature: NA.51.35.D02.2.454.heavy.2.nb
  modified_base (298)..(298): a, c, t, g, unknown or other
gagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcggtggggggggctggtccaggcgtggggaggtccctgagactctcctgtgcagcctctggatcaccttcagtacccatgaaatgcactgggtccgccaggctccgaggcaaggggctgggagtggggtgcagttatatctatgatggaancaa

SEQ ID NO: 443758 - DNA, 398 bp, Homo sapiens
  misc_feature: NA.51.37.D04.1.454.heavy.2.nb
  modified_base (333)..(333): a, c, t, g, unknown or other
cccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctgtggacttcaccttcagtggctacttcatgagctggactccgcaggctccgaggggagggctgcaggtggtctcacatattagtgactaagtggggaaaaccatattcacgcagactctggagaagggccattcccatcncaggacaacgccaaagactcactgtatctgacaaatgaacagtacaaagagaccgaagaccacgg

SEQ ID NO: 443759 - DNA, 441 bp, Homo sapiens
  misc_feature: NA.51.38.D05.1.454.heavy.2.nb
  modified_base (396)..(396): a, c, t, g, unknown or other
tggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttacgtgcgccaggaagcagtggctggccacatcatgtcttttgattatcgtagggacgaccgaaagggacaagtggtcatcgtctcgttcggcctccaccaagggcccagtccggtcttccccctggccaccctcctccaagcncacctcgtggggcacagcgccctgggctgcctggtcaaggactac

SEQ ID NO: 443760 - DNA, 407 bp, Homo sapiens
  misc_feature: NA.51.6.A06.3.454.heavy.2.nb
cagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaaggggctgcagtgggtgcatctatatcatatgaaggaagcaaataaatactacgcagactccgtagaaggccgattcaccatctccagagacaatcccaaagaacactactttactagacaaatcgaacaccctgagacttgaggacacggctgtctattat

SEQ ID NO: 443761 - DNA, 338 bp, Homo sapiens
  misc_feature: NA.51.73.G07.1.454.heavy.2.nb
  modified_base (295)..(295): a, c, t, g, unknown or other
  modified_base (312)..(312): a, c, t, g, unknown or other
tttagctctacgctcagggcacgaccggtgctcgatttagatagctctcgttgggtttgggctgagctggcttttctgtggctattttaaaaggtggccagtgtgaggtgcagctgttagagtctgggggaggcttggtccagccgtggggggtccctcagactctcctgtgcagcctacggaattatatttaagaactttgccatgagttgggtccgcaggctccgagggaagggctggaatgggtctccactattagtggcagcggtgatgacacattctaccacagactcgngaacggggccttcaccntctcagagacaatcgacaaagacacg

SEQ ID NO: 443762 - DNA, 372 bp, Homo sapiens
  misc_feature: NA.51.76.G10.2.454.heavy.2.nb
agcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcccgggagtccctgagactctcctgtgcagcctctggattcaccttcagtgcctatggcatgcacgtgggtcccgccaggcctccgaggcgaaggggctgggaggtggggtggctatttaatcagatgatggacagtaaataagagtatgcagtctcgtagaacggccgattcacatctccagagacaactcccaagaaacacatgtatctagac

SEQ ID NO: 443763 - DNA, 420 bp, Homo sapiens
  misc_feature: NA.51.78.H01.2.454.heavy.2.nb
agaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggagcctggtacagcctggcaggtccctgagactctcctgtgcagcctctggattcacctttgatgattatgccatgcacgtgggtccgcaagctccgaggggaaggcctgggagtgggtctcgacgttattaggttggaataggtggtagtatagcctatgcgactcgtgtgaagggccattcaccatctccagagacaacgccaaagaacctccctgtactctgacaaatgaacagtctagagagctgaggacgacggtccttgta

SEQ ID NO: 443764 - DNA, 368 bp, Homo sapiens
  misc_feature: NA.51.82.H05.2.454.heavy.2.nb
cgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagagccgtggggcctcgagtgaaggtctcctgcaagacttctggatacaccttcaccgactactatatgcacgtgggtgccgacacggcccctggacaagggcttggagtggatgggatggatcgacctaagaatggtgccacaaactatgcacagtactttcagggctgggtcaccatgacca

SEQ ID NO: 443765 - DNA, 342 bp, Homo sapiens
  misc_feature: NA.52.19.B08.1.454.heavy.2.nb
cagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggagtccctgagactctcttgtgctgcctctggattcaccttcagggtctatgacatgcacgtgggtccccaggcctccgaggcaaggggctgggagtgggtgctatttaatcatatgatggaagcaagatatactatgtagactcgtgaggccgatcatcatctacagacgacaactcga

SEQ ID NO: 443766 - DNA, 290 bp, Homo sapiens
  misc_feature: NA.52.20.B09.2.454.heavy.2.nb
gcccagcactggaagtcgccggtgtttccattcggtgatcatcactgaacacagaggactcaccatggagtttgggctgagctgggttttcctcgttgctcttttaagaggcgtccagtgttatgtgcagctggtggagtcgtgggggaggcgtggtccagcctggggacgtccctgagactcgcctagtaaccgtcgatttacctcagtaactatgcaatgcacgtgggtcccgcaggcctccgaggcaaggggctggacgtggggtgcagctatatctatttgatgga

SEQ ID NO: 443767 - DNA, 419 bp, Homo sapiens
  misc_feature: NA.52.22.B11.1.454.heavy.2.nb
  modified_base (154)..(154): a, c, t, g, unknown or other
tttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttancagtggtactggtggtagcacatactacgcagactccgtgaagggccgttcaccatctccaaagacaattccaagaacacgctgtatttacaaatgaacagcctgagagccgaggacacggccgtatatactgtgtagaaagatctccacgtctccgcccccttggactgttattcgactccgtgggccagggaaccctagtacgccgtctcctcacgcctccaccaaacgggcccagtccggtccttccccctggccacccctc

SEQ ID NO: 443768 - DNA, 361 bp, Homo sapiens
  misc_feature: NA.52.33.C11.4.454.heavy.2.nb
acgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcggtggggggggctggtccaggctggggaggtccctgagactctcctgtgcagcctctggattcaccttcagtacccatgaaatgcacgtgggtccgccaggctccgaggcaaggggctgggagtggggtgcacttatatccctatgatggaagcaatagcactacgcagagtccgtgaaacgggccgattgaccatctaccagaacgacaactacg

SEQ ID NO: 443769 - DNA, 463 bp, Homo sapiens
  misc_feature: NA.52.34.D01.1.454.heavy.2.nb
gtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtattacaaatgaacagcctgagagccgaggacacggccgtatattactgtgtgaaagatctccacgtctccgcccccttggactggttattccgactccgtgggccagggaaccctagtcgccgtctcctcacgcctccaccaacgggcccatcggtccttccccctggcccacccctcctccaagacgccacctcgtcgggggcacgacgccggcccgtggggctcgcctggtcaagggcctacttcctattacgatcg

SEQ ID NO: 443770 - DNA, 333 bp, Homo sapiens
  misc_feature: NA.52.37.D04.2.454.heavy.2.nb
  modified_base (179)..(179): a, c, t, g, unknown or other
tgctcgatttagtagcatactgttgggtttggggcgtggtccagcctgggaggtccctgagactctcctgtgcaggctctgcatttcccttcagtaactatgctatcgattgggtccccaggctccaggcaagggactggagtgggtggcagttatatcagctgatggagcagtaaatnttacgcagattctgcgaggggccgattcaccatatccagagacaactcccaagatatgatatatctaacaaatgaacagcctgagaccctgagacacggctagtatttatgtgcgtgagggggcagtgctggcacgtgatgtctttgatttcgt

SEQ ID NO: 443771 - DNA, 541 bp, Homo sapiens
  misc_feature: NA.52.53.E09.1.454.heavy.2.nb
  modified_base (450)..(450): a, c, t, g, unknown or other
gagaggagcccagcactgggattccgaggtgtttccattcagtgatctgcactgaacacagaggactcgccatggagtttgggctgagctgggttttcctgttgctattttaaaaggtgtccagtgtggagtgcaggtggtggagtcgtgggggagcttggtccagcctggtggttccctgagactctcctgtgcagcctctggattctccgtcagtagcaactacatgagctgggtccgccaggctccaggggaaggggctggagtgggtctcaagtctttatgtcggtggtaccacatattatgctgactccgtgaagggccattcaccatctccagagacgagtccaggaacagcctgttctcaaatggacagtctgagacctgacgacacggctgtctattactgtgcgagagaacccgagggggcggagcacgccccgtaatcgnggggccaaggggaacccggtcaccgtctcctcacgccctccaaccgaacgggcccagtccggtccttcccccgtggccacccctcctaccc

SEQ ID NO: 443772 - DNA, 554 bp, Homo sapiens
  misc_feature: NA.52.53.E09.2.454.heavy.2.nb
gagaggagcccagcactgggattccgaggtgtttccattcagtgatctgcactgaacacagaggactcgccatggagtttgggctgagctgggttttcctgttgctattttaaaaggtgtccagtgtggagtgcaggtggtggagtcgtgggggagcttggtccagcctggtggttccctgagactctcctgtgcagcctctggattctccgtcagtagcaactacatgagctgggtccgccaggctccaggggaaggggctggagtgggtctcaagtctttatgtcggtggtaccacatattatgctgactccgtgaagggccattcaccatctccagagacgagtccaggaacagcctgttctcaaatggacagtctgagacctgacgacacggctgtctattactgtgcgagagaacccgagggggcggagcacgccccgtaatcgggggccaacggggaacccggtcaccgtctcctcagccctaccaacccgaaacgggcccacgtccggtccttcccccgtggcccacccctcctcccaaacgacgcc

SEQ ID NO: 443773 - DNA, 359 bp, Homo sapiens
  misc_feature: NA.52.57.F02.2.454.heavy.2.nb
cccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttatactgtgcgaaagatcgaggtcgcatgactagtttttggagtcggaccaaaagacggcaggttccgcgtacggggttgacgtctggggccaagggccaggtcaccgtcgcctcagc

SEQ ID NO: 443774 - DNA, 195 bp, Homo sapiens
  misc_feature: NA.52.6.A06.2.454.heavy.2.nb
  modified_base (176)..(176): a, c, t, g, unknown or other
agactctcctgtgcaggctctgcatttcccttcagtaactatgctatcgattgggtccgccaggctccaggcaagggactggagtgggtggcagttatatcagctgatggaggcaataagtattacgcagattctgcgagggccattcaccatatccagagacaactccaagatangatatatctgacaaatgaa

SEQ ID NO: 443775 - DNA, 308 bp, Homo sapiens
  misc_feature: NA.52.66.F11.1.454.heavy.2.nb
ccctgggattttcaggtgttttcatgtggtgatcaggactgaacagagagaactcaccatggagtctgggctgacgtggtctttttcttgtggctattttaaaaggtgtccaatgtgacgtgcaactggtggagtcgtgggggagcttgaaacagccgtgggggtccctgagactctcctgtagaacctctggcttcacgtttagagtctatgacatgagttgggtccgccaggcgtccggggaagggctggagtgggtctcaatgatcagtgatgatggacgtagaccaacaaaatcgccgactccg

SEQ ID NO: 443776 - DNA, 383 bp, Homo sapiens
  misc_feature: NA.52.69.G03.1.454.heavy.2.nb
gctgggttttccttgttgctgttttagaaggtgtccagtgtgaggtgcacctggtggagtccgggggagacttggtccagccggggggtccctgacaatttcctgtgcaggctccgggttcagtttcagtgattcctggatgagctgggtccgccaggctccgaggggaggggctggacgtgggtggccagtaataaacccggatggaagtattaggctacgtttggggtattctgtggacgggccggtcaccatctccagggacaacaccgcgaactccttctatctaacaaatgagcagccttagaggcgaggactcccgctgtctattactgtcgccgacccgtccgggggacagggaaacgtcttttgcctcgtcgggg

SEQ ID NO: 443777 - DNA, 422 bp, Homo sapiens
  misc_feature: NA.52.73.G07.1.454.heavy.2.nb
tttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtcccctcacctgcgctgtcgatggtgggtccttcagtggtcgctactggacctggatccgccacgcccccgaggggaagggctggagtggagttggggaaatcaatcatactggaagccattaactataacccgtcccttaagagtcgagtcaccatatcagtcgacacgtccaagaaccaattctaccctgaaggtgaggtctgttaccgccgcggacacggctgtctattactgtgcgaaaggccctcgacg

SEQ ID NO: 443778 - DNA, 320 bp, Homo sapiens
  misc_feature: NA.52.73.G07.3.454.heavy.2.nb
  modified_base (239)..(239): a, c, t, g, unknown or other
tttagctctacgctcagggcacgaccggtgctcgatttagagctcacgtattgggtttggggaggcttggtccagcctggtggttccctgagactctcctgtgcagcctctggattctccgtcagtagcaactacatgagctgggtccccaggctccgaggggaagggctggagtgggtctcaagtctttatgtcggtgtaccacatatatgctgactcgtgaaggccattcaccatcnccagacgacgagtccaggaacagccttgtttctacaaatggacagtctgacgacctgacgacacggctgtactattacgtg

SEQ ID NO: 443779 - DNA, 364 bp, Homo sapiens
  misc_feature: NA.52.76.G10.2.454.heavy.2.nb
  modified_base (210)..(210): a, c, t, g, unknown or other
gcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagccgtgggaggtccctgagactctcctgtgcaggctctgcatttcccctanaataactatgctatcgatgggtccgccaggctccaggcaagggctggagtgggtgcagtaatatcagctgatggagcaactaaatatacgcagattcgtgcgaggggccattcaccatatccagagacaactacccaagatatgatatatctaa

SEQ ID NO: 443780 - DNA, 419 bp, Homo sapiens
  misc_feature: NA.52.77.G11.1.454.heavy.2.nb
  modified_base (408)..(408): a, c, t, g, unknown or other
aggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctggggagtccctgagactctcctgtgcagcctctggattcaccttcagtgtctatgacatgcacgtgggtccgccaggcctccgaggcaaggggctgggagtggggtgcagttatatcatatgatgggaaataagatatactatgcagactccgtgaacgggccgattcaccatttccagagacaactccaagacacgctgtatttgcaaatgacagcctgagagctgaggacacggctgngtataactgtg

SEQ ID NO: 443781 - DNA, 283 bp, Homo sapiens
  misc_feature: NA.52.8.A08.1.454.heavy.2.nb
gcccagcactagaagtcggcggtgcttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccaggccgtggggacgtccctgagactctcttgtgcagcctctggattcaccttcagggtctatgacatgcacgtgggtccccaggcctccgagggcaaggggctgggagtggggtgccagtta

SEQ ID NO: 443782 - DNA, 316 bp, Homo sapiens
  misc_feature: NA.52.82.H05.2.454.heavy.2.nb
cgatttagatcgtctgtgttgggtttgggtccggcagccccccgggaagggcctggagtggattggagatatctactacagcggggcaccagctacagtccctccctcaagagtcgagttggcatatcaatagacacgtccaagaatcagttctccctgaagctgaaatctatcattgtgcggacacggcctctattattgtgcgagacatggcagcccatatagtcgctggttccgaccccgtggggcccggaatcccggtccaccgtctccccagccttccaccaggcccccatcggtctccccctggccgccc

SEQ ID NO: 443783 - DNA, 258 bp, Homo sapiens
  misc_feature: NA.52.82.H05.4.454.heavy.2.nb
  modified_base (251)..(251): a, c, t, g, unknown or other
cgatttagtcgagctctctcgcgggcacgaccggtgctcgatttagtcgagctctctcgcgggcacgaccggtgctcgatttagagagagtgtgttgggttggggagcttggtccagcctggtggttccctgagactctcctgtgcagcctctggattctccgtcagtagcaactacatgagctgggtcccaggctccgagggagggctggagtggtctcaagttctttaggtcggtgtaccatatattangctgact

SEQ ID NO: 443784 - DNA, 385 bp, Homo sapiens
  misc_feature: NA.52.86.H09.2.454.heavy.2.nb
gacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggcgtgggacggtcctgagactctcctgtgcagcctctggattcaccttcagtacccatgaaatgcacgtgggtccgcaggctccgaggcaaggggctgggagtgggtgcagttatatccctatgatggaagcaatagcaactacgcagagtccgtagaagggccattcgaccatcgtccagacgacaacaccgaagaagtaacggttacgttacttaacc

SEQ ID NO: 443785 - DNA, 307 bp, Homo sapiens
  misc_feature: NA.8.19.B08.1.454.heavy.2.nb
  modified_base (200)..(200): a, c, t, g, unknown or other
  modified_base (229)..(229): a, c, t, g, unknown or other
cactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcaccttnagtaactacggcgtgcacgtcgggtcccnccaggcctccgaggcaaggggcttggagtggctggctagtttgtttcatcgtagaaggtagtcgttacaatactatac

SEQ ID NO: 443786 - DNA, 402 bp, Homo sapiens
  misc_feature: NA.8.25.C03.1.454.heavy.2.nb
gagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactcgtgggggaggcttggtacagccagggcggtccctgagactctcctgtacagggactggattcatctttggtgactatgctgtgacctgggtccgccaggctccgaggggaagggctggagtgggtaagtctcattagaagtaaagcttatggtgggacaacagattacgccgcgtctgtgaaaggcagattcaccatctcaagagatgattaccaaaagcatcgccttctacaaatggacagcctagaaaccg

SEQ ID NO: 443787 - DNA, 417 bp, Homo sapiens
  misc_feature: NA.8.26.C04.2.454.heavy.2.nb
aagactgacggtcccccctgggattttcaggtgctttcatttggtgatcaggactgaacagagagaactcaccatggagtttgggctgagctggcttattttcttgtggcttaattttaaaaggtgtccagtgtgaggtgcagttggttggagtcgtgggggagggttggtacagcctggggggtccctgagactctcctgtgcagcctctggattcacctctggcagctttgtcatgagctgggtccgccaggctccgagggaaggggctggagtgggtctcatctatgagtggtagtggtggtcacacacactacgcagactccgtgaagggccgttcaccatctccagagacaattccaagaacacggtgtatctgacaaatgaacagcctgagagccgagacacggcctatat

SEQ ID NO: 443788 - DNA, 391 bp, Homo sapiens
  misc_feature: NA.8.33.C11.2.454.heavy.2.nb
aggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcacgtcgggtcccaccaaactccgaggcaagggattgggagtggggtgctagttgttcatccgtgagggcagtgttcaagtgtatgctgacgcgtgaacggccgatcacatctccagagacaactcagaacacaatgtattggacctgaacacgacctaagtcc

SEQ ID NO: 443789 - DNA, 412 bp, Homo sapiens
  misc_feature: NA.8.34.D01.2.454.heavy.2.nb
gagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcacgtgggtccgccaagctccaggcaagggttgggagtggggtgcagttgtttcatctgagggcagtgttcaagtggtatgcagactcgtgaaggccgattcaccatctccagagacaattccagaacacaatgtattggagctagaacagcctaagtcctagaggacacgggcgtatacta

SEQ ID NO: 443790 - DNA, 432 bp, Homo sapiens
  misc_feature: NA.8.38.D05.1.454.heavy.2.nb
ccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggctgcactgggtccgccaaaggctccaggcaagggcttggagtggctggcagttgtttcatctgaaggcagtgttcaatctatacagactccgtgaagggccgattcaccatctccagagacaattaccaagaacacgatgtatctgacaaatggacagacctaagagttagaggacacggctagttatactagtacgaaagagggggatagaagt

SEQ ID NO: 443791 - DNA, 252 bp, Homo sapiens
  misc_feature: NA.8.42.D09.2.454.heavy.2.nb
gcccagcactgggattccgaggtgtgtccattcggtgatcagcactgaacacagaggactcaccatggagttctggctgggctgggttttccttgttgcaatttcaaaggtgtccagtgtgaggtgcagctggtggagaatgggagggggcttgatccgaggccgggggggtccctgagactctcctgtgcagcctctggcttcaccatcagtagagactacatgagctcgggccccgcgaggctccgaggg

SEQ ID NO: 443792 - DNA, 302 bp, Homo sapiens
  misc_feature: NA.8.82.H05.1.454.heavy.2.nb
cacccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctcctgcaaggcgtccggttaagttcacaacgtatggtattagttgggtgcgacaggcccctggacaagggcttgagtggatggggtgatcagcgccttcaactattacacaaactatgcacagaacgttccgtgacagagtcac

SEQ ID NO: 443793 - DNA, 266 bp, Homo sapiens
  misc_feature: NA.9.1.A01.2.454.heavy.2.nb
aggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggagctcgggtcaagccgtggggatcccttagactctcctgtgcaacctctggattcaatttcgacatcgcctggatgagttcggcccgcaggctccgagggaggctggagtggg

SEQ ID NO: 443794 - DNA, 152 bp, Homo sapiens
  misc_feature: NA.9.11.A11.2.454.heavy.2.nb
  modified_base (105)..(105): a, c, t, g, unknown or other
gagagtcgactctccatgtcccttgacacgtctaagaaccagtattccctgcaactgagctccgtgactgccgctgacacggtcctttattactgtgccataacngcctgtattactaccagttgctatcatctgagtccggacagctactt

SEQ ID NO: 443795 - DNA, 457 bp, Homo sapiens
  misc_feature: NA.9.12.B01.1.454.heavy.2.nb
agaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccgaggggaaggggctgggagtgggtctcagttatttatagcggtggtaacacatactacgcagactccgtgaagggcagattcaccatctccagagacaattccaggaacacgctgtatcttacaaatgaacagcctagagagtcgaggacacggctgtatattactgtgcgagagatgtgttacgtcttttgatatcgtaggggccaaa

SEQ ID NO: 443796 - DNA, 457 bp, Homo sapiens
  misc_feature: NA.9.14.B03.1.454.heavy.2.nb
tcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggggccaggggaaccctggtcaccgtctcctcagcctccaccaagggcccatccggtccttccccctggccgcccctgcctccgaggacgccacctccgagagcacagccggccctgggctgcctggtcaacggctactccagacgtatc

SEQ ID NO: 443797 - DNA, 428 bp, Homo sapiens
  misc_feature: NA.9.28.C06.1.454.heavy.2.nb
  modified_base (302)..(302): a, c, t, g, unknown or other
tgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccaggaaaggccctggaatggcttgcattcgtttattggaatgatgataaacgctacagacccatctctgaggaccaggctcacccattaccaagacacctaccaaaacngtgtctacatgacaacatggaccctgtgacacagccacatattactgtgacacacagtgtcatgactgcggtgactgttctcccctttggctcgttggggccagggtaaccctggttccgccgttc

SEQ ID NO: 443798 - DNA, 578 bp, Homo sapiens
  misc_feature: NA.9.30.C08.1.454.heavy.2.nb
gcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaacttgacttctggggccagggactccctggtcaccgtctcctcagccctccaccaagggcccccatccggtcttccccctggccgccctgctccaggacgccacctccgagagcacagccggccctggggctgcctggtcaaggactacttccagacgtatca

SEQ ID NO: 443799 - DNA, 537 bp, Homo sapiens
  misc_feature: NA.9.31.C09.1.454.heavy.2.nb
  modified_base (238)..(238): a, c, t, g, unknown or other
ggagccccagccttgggattcccaagtgttttcattcagtgatcaggactgaacacagaggactcaccatggagtttgggctgagctggattttccttgctgctattttaaaggtgtccagtgtgaggtgcaactggtggagtcgtgggggaggctcggtcaagccgtggggatcccttagactctcctgtgcaacctctggattcaatttcgacatcgcctggatgagttcggcccncaggctccgagggaggctggagtgggtgacgtacgtaaaagcaagggtagcggtgggacagcagactacgcttcatccgtgaagggcagattcagcatttccagagacgatgcaagacagatgatgtatttacagatgaacagacctaaaaatcggagacacagccctatatttctgcgtcttcatttcgcagtgggagcttccgggtttacggtcggtgacgttcgtgggggccgggagccagtcggtcaccgtctcctcagccctccaccgaacgggcccagtccggtccttccccc

SEQ ID NO: 443800 - DNA, 595 bp, Homo sapiens
  misc_feature: NA.9.33.C11.1.454.heavy.2.nb
aggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccattcaccatctccagagacaattccaaagaacacgatgtatctgacaaatggacagcctaagagttgaggacacggctgtttatactgtacgaaaggagggggatacgagtggcagcctaccaagtactactttgacttcgtggggccagggaaccctggtccaccgtctcctcacgcctccaccaagggcccatccggtccttccccctggccgccctgcctccgaggacgccaccgtccgagacgcacacgccggcccgtgggctcgcct

SEQ ID NO: 443801 - DNA, 555 bp, Homo sapiens
  misc_feature: NA.9.34.D01.1.454.heavy.2.nb
ctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatagtgggaagtacgtattttcgatccctcgcgtcgactactttgattacggtgggggcccgggaaccctggtcgccgtctcctcacgccctccaccaacgggcccagtccggtccttcccccgtggccacccctcctccaagacgccacctcgtcgggggccacgacgccggccctggggcctggccgtcggtcaaggactaacgttccagacgtatca

SEQ ID NO: 443802 - DNA, 280 bp, Homo sapiens
  misc_feature: NA.9.37.D04.2.454.heavy.2.nb
aggagcccagccctgggattttcaggtgttttcatttggtgatcaggactgaacagagagaactcaccatggagtctgggctgagctggcttcttcttgtggctaattttaaaaggtgtccagtgtgaggtgcatctattggagtcgtgggggagccctggtacaggccgggggggtccctgacactctcctgtacagcctctggattcacctttaacacctatgcattgagctgggtcccgccgacgggcccccgaggggaacggggctgggacgtggg

SEQ ID NO: 443803 - DNA, 364 bp, Homo sapiens
  misc_feature: NA.9.43.D10.1.454.heavy.2.nb
agcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagccgtggggggtccctgagactctcctgtgcagcctctggcttcgccgtcagtggcgactacatcgacctgggccccgccaggcctccgaggggaaggggctggaatgggtctcgagttatcataccgacggtaccatatatgacgcagaactccgtgaacgggccattccacatctaccagacgaccattccaaagaaccaccctata

SEQ ID NO: 443804 - DNA, 395 bp, Homo sapiens
  misc_feature: NA.9.53.E09.1.454.heavy.2.nb
ttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatggtggggccaagggacaatggtcaccgtctcttcagcctccaccgaacgggcccatcggtcttccccctggccgccctgctccaggagcacctccgagagcacagccggccctgggcctgcctggtcaaggcctacttccagacgtatca

SEQ ID NO: 443805 - DNA, 397 bp, Homo sapiens
  misc_feature: NA.9.53.E09.2.454.heavy.2.nb
ttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatggtggggccaagggacaatggtcaccgtctcttcagcctccaccgaacgggcccagtccggtccttcccccgtggcccgcccctgcctccgaggacgccaccctccgagacgcacgacggccggcccgtggggctcggccgtagggtaccaa

SEQ ID NO: 443806 - DNA, 237 bp, Homo sapiens
  misc_feature: NA.9.53.E09.4.454.heavy.2.nb
tgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtgctccatcagtacttactactggacctggatccggcacgcccggcgggaaggacgtggagtgggtggtcgtta

SEQ ID NO: 443807 - DNA, 500 bp, Homo sapiens
  misc_feature: NA.9.63.F08.1.454.heavy.2.nb
  modified_base (497)..(497): a, c, t, g, unknown or other
acaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacagcggccctgggctgcctggtcaaggctacttccagacgtntca

SEQ ID NO: 443808 - DNA, 460 bp, Homo sapiens
  misc_feature: NA.9.64.F09.1.454.heavy.2.nb
tagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagtcactattggatgagttgggtccgccaggctccgaggggaagggcctgggagtgggtggccaacataaaggagatggaagtgagaagtcctatgtgactctgtgaagggccgattcatcatctccagagacaacgccgagaactccctgtatctgacaaatgaacagcctagagagtcgaggacacggctatgtattattgtgtgagagataaaagtggggacaagggaaccctggtcaccgtcgcctcacg

SEQ ID NO: 443809 - DNA, 564 bp, Homo sapiens
  misc_feature: NA.9.70.G04.1.454.heavy.2.nb
cttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtggacccatctacaaccccgtcctcaagagtcgagtcagcatgtcagtcgacacgtcccagaaccagttctccctgacagtgagttatatgaccgccgcagacacggccgtgtattactgtgcgagagaggccgttatttaggaccagcctagttaaaaactcctactacggtctgggcgtctggggccaggggaccaagggtcaccgtctcctcagcctccaccgaagggcccatccggtccttcccccgtggccgccctgggcctccgaggacgcacctccgagacgcacagcggccctgggcttg

SEQ ID NO: 443810 - DNA, 365 bp, Homo sapiens
  misc_feature: NA.9.76.G10.2.454.heavy.2.nb
cactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgataggaaattaaaaaatactatgacagactccgtagaacgggccgattcaccatctccagagacaactaccaagaacacgctagttctag

SEQ ID NO: 443811 - DNA, 458 bp, Homo sapiens
  misc_feature: NA.9.78.H01.1.454.heavy.2.nb
tcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaactaacccgttcgccttggttattaccttgacacgttggggccagggaaccctggtccaccgtctcctcacgccctccaccgaacgggcccagtccggtcccttcccccgtggcccgccctgcctccgaggacgccacctccgagacgcacacgccggccctggggctcgccgtgggtaccaaacgg

SEQ ID NO: 443812 - DNA, 408 bp, Homo sapiens
  misc_feature: NA.10.1.A01.1.454.light.2.nb
agcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccaccctccaagcctcctctccgacaggaactaacactcccggccctcgagggactcctcagagagattctctgcatccaggtcaggaagcacagcctccctgaccattactggactccagctgacgacgaagctgattatactgctcagcatgggacaccggctcagtgcgtgggtttcggcggaggaccaagctcgaccgt

SEQ ID NO: 443813 - DNA, 308 bp, Homo sapiens
  misc_feature: NA.10.11.A11.2.454.light.2.nb
tcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccagccaccacccaggccaaacgcccccaaactccttgttttgaggtcagtaagcggccctcaggacgtccctgactcggttctctcgcctccaagtctggcaaca

SEQ ID NO: 443814 - DNA, 424 bp, Homo sapiens
  misc_feature: NA.10.12.B01.1.454.light.2.nb
aggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggactccctgagcgattctctggcctccagctcagggacaacagtgacgttgaccatcagcggagcccggacaggaggacgaggctgactattactgtcaaatcaacaagacattactggtacttagttgggtgttcgggcggagggtcaagctgaccgtctaggtcacgcccaagg

SEQ ID NO: 443815 - DNA, 430 bp, Homo sapiens
  misc_feature: NA.10.17.B06.1.454.light.2.nb
taggacccagacggaaccatggaagccccagcgcagcttctcttcctcctgctactctggctcccagataccactggagaagtagtgatgacgcagtctccggccacctgtctgtgtctccaggggaaagtcaccctctcctgcagggccagtcagactattagtacaaacttggcctggtaccagcataaacctggccaggctccaggctcctcatccatggtgcatcctccagggccactaatactcccagccaggttcagtggcagtgggtcggggtcagagttcactctcaccatcagcagcctgcagtctgaagtattttgctagtttattactgtcagcagtatgatacctggcctcgtactacgtttggccggggtacaagctaggaaatcaagcgaactgtaggctgcaccatctgttcttc

SEQ ID NO: 443816 - DNA, 403 bp, Homo sapiens
  misc_feature: NA.10.20.B09.1.454.light.2.nb
taggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaccaacttagcctggtatcaacaaaagcctggccaggctcccagactcctcatctctggtgcatcttcgagggccacgtggtcgtcccagccaggttcagtggcaggtgggtctggaacagagttcactctcaccatcagcgctgcagtctgaagtattttgctagtttatactgtcagctagtataatgtacttgggtttatcactttcggcctgggacctaaaggtcggttatt

SEQ ID NO: 443817 - DNA, 233 bp, Homo sapiens
  misc_feature: NA.10.21.B10.2.454.light.2.nb
  modified_base (142)..(142): a, c, t, g, unknown or other
tgctcagttaggacccagagggaaccatggaagccccagctcagcttctcttcctcctgctactctggctcccagacaccaccggagaaattgtgttgacacagtctccagccacgctgttctttgtctccgaaggggaaancgccaccctctcctgcagggccagtcagagtgttcgctacgttcggttagggtgtatcaacataaactccggcaggcctcccaggctcctc

SEQ ID NO: 443818 - DNA, 425 bp, Homo sapiens
  misc_feature: NA.10.25.C03.1.454.light.2.nb
tggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaagggccactggtatcccagccaggttcagtggccagtgggtctgggacagagttcgctctcaccatcagcagtctgcagtctgaagtattttgctagtttattactgtcaggaatatgatggctggcctcgtactacgtttggcctaaggggacctaaggttggacatac

SEQ ID NO: 443819 - DNA, 420 bp, Homo sapiens
  misc_feature: NA.10.27.C05.1.454.light.2.nb
agaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttagaagtcagtaagcggccctcgtaggggtttctagtcgcttcctctgcctccaagtctggcaacacggcctccctgacaatctctggctccaggctgacgacgagctgaatattactgcagctcatatgtagatggtcgccttctttcgaaggttttcggcggttagggaccaggcgtgacc

SEQ ID NO: 443820 - DNA, 425 bp, Homo sapiens
  misc_feature: NA.10.28.C06.1.454.light.2.nb
tcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaatgatgatttatgatgtcagtaatcgaccctcgtaggggtttctgatcgcttctttgcctcaagtctggcaacacggcctcctgaccatctctgggctccagactgaggacgagctgattattactgcagctcacatacaagcggcagcggttgggtgttcgggcgggggaccacgacgtcgaccgtcgtaggtc

SEQ ID NO: 443821 - DNA, 379 bp, Homo sapiens
  misc_feature: NA.10.37.D04.1.454.light.2.nb
attccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcaggcggcggtgggtctggggacagacttcactctcaccatcagcagcctgcagtctgaggaccttggtagtttatactgtcagccagtatcataactggcctcgtggacgttcggaccaaggggaccaagggtcgacctacaaaacgactgtggctgcaccatctgtcttcatccttcccgc

SEQ ID NO: 443822 - DNA, 367 bp, Homo sapiens
  misc_feature: NA.10.38.D05.5.454.light.2.nb
  modified_base (298)..(298): a, c, t, g, unknown or other
aggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccaccaggcaaacgcccccaaactccttgttttgaggtcagtaagcggcctcaggacgtccctgatcggttctctcgcctcaagtctggcaacncggcctccctgaccgtctcgtgggctccgagctgaggatgaggctgattacactgcagcgctatattca

SEQ ID NO: 443823 - DNA, 290 bp, Homo sapiens
  misc_feature: NA.10.38.D05.6.454.light.2.nb
agactgacggtcctgccacaggtggtgctgggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaaggcccatcggtcttccccctggcgccctgctccaggagccacctccgagagcacagcggccctgggctgcctggtcaaggctactcccccactactatg

SEQ ID NO: 443824 - DNA, 353 bp, Homo sapiens
  misc_feature: NA.10.39.D06.1.454.light.2.nb
taaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggcccctgtggttgtcgtctataatgataacgaccggccctcagggactcccgtgagccgattcctctcggctccaagttcgggcaacgacggccacctcatcatcaccgagggtcgagggccggggatcggacggaccgac

SEQ ID NO: 443825 - DNA, 350 bp, Homo sapiens
  misc_feature: NA.10.40.D07.1.454.light.2.nb
  modified_base (292)..(292): a, c, t, g, unknown or other
cccaatatgttctgacacagccgccctcagtgtccggggcccccgggcagcgggtcaccatctcctgcactgggaacaacttcaacatcggggcagcttacgatgtccactggtatcgccaacttccaggcatagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattacactgcagtcgtatgacnccaagctagaaactttggggtcttcgggcggagggacaggctcgaccgtcctacgtca

SEQ ID NO: 443826 - DNA, 377 bp, Homo sapiens
  misc_feature: NA.10.43.D10.1.454.light.2.nb
  modified_base (224)..(224): a, c, t, g, unknown or other
taggacccagagggaaccatggaagccccagctcagcttctcttcctcctgctactctggctcccagtttcagataccaccggagagattgtgttgacacagtctccagccaccctgtctttgtctccaggggaaacgccaccctctcctgcagggccagtcagagtgttggcgcctagtagcctggtaccaacagaaacctggccaggcctcccaggcccctnatctatggtgcatccaacagggccactggcatcccagccaggttcagtggccagtgggtctgggacagacttcactctcaccatcatcagcctggagcctgaagatgttgctagtttattactgtacaacatcgtaccgagtggccgtccggg

SEQ ID NO: 443827 - DNA, 337 bp, Homo sapiens
  misc_feature: NA.10.44.D11.2.454.light.2.nb
taggacccagagggaaccatggaagccccagctcagcttctcttcctcctgctactctggctcccagtttcagataccaccggagagattgtgttgacacagtctccagccaccctgtctttgtctccgaggggaaagccaccctctcctgcagggccagtcagagtgttggcgcctagtagcctggtaccaacagaaacctggccaggctcccaggcccctcatctatggtgcatccaacgggccacgtggcatcccagccaggttcagtggccaggtggtctgggacagacttcactctcaccatcatcagcctggacgcctgaagatgtgctag

SEQ ID NO: 443828 - DNA, 398 bp, Homo sapiens
  misc_feature: NA.10.48.E04.1.454.light.2.nb
gctcagttaggacccagagggaaccatggaagccccagctcagcttctcttcctcctgctactctggctcccagataccaccggagaaattgtgttgacacagtctccagccaccctgtctttgtctccgaggggaagagccaccctctcctgcagggccagtcagagtgttagcatctacttagcctggttccaacagaaacctggccaggcctcccaggctcctcatctataatgcatccaacagggccacgtggcatcccagccaggttccagtgcagtggtctgggcagacttcactctcaccatcagcagcctagagcctgaagtatttgctagtttattactgtcagctagtcgttcgcctggcctcactactttcgccgtacggggaccaa

SEQ ID NO: 443829 - DNA, 347 bp, Homo sapiens
  misc_feature: NA.10.50.E06.1.454.light.2.nb
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacacccaggcaaacgcccccaaatcataattcatgatgtcaataatcggccctcaggggtttctaatccgtcttctctggcttcaagtctggcaacacggcctccctgaccatctctgggctccgagctgaggacgaggct

SEQ ID NO: 443830 - DNA, 349 bp, Homo sapiens
  misc_feature: NA.10.53.E09.2.454.light.2.nb
acaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctaccgacaataagaactacttagcttggtaccagcagaaaccaggacagcctctaagctgctcatttactgggcatcgtacccgggatccccggggtcctgaccgattcagtgcagcgggtctgggacagatttcactctcaccatcagcacgcctgcaggctagaagatgcg

SEQ ID NO: 443831 - DNA, 427 bp, Homo sapiens
  misc_feature: NA.10.55.E11.1.454.light.2.nb
  modified_base (136)..(136): a, c, t, g, unknown or other
cagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagtagtagttattagcctggtatcggacaaaacctggccaggctccccgactcctcttctttggtggagcctacagggccactggccaccccagacaggatcagtggcaggcgggtctggggacagacttcattctcaccatcaaacagactgcagcctagaagatattgctagtttactactgtcagcagtatgttacgtcccggtggtacgttcggaccgaagggaccaagggtcgacaataccaaccgaactg

SEQ ID NO: 443832 - DNA, 404 bp, Homo sapiens
  misc_feature: NA.10.59.F04.2.454.light.2.nb
caggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgctcctggtaccaacagcagccaggcgaacgcccccaaattcatgatttatgatgtcagtgcgcggcccccgtcgggggtcctgactcgcttctctggctccaagtctggcaacacgcctccctgaccatctcgtcggcctccagcctgacgatgaggctgattattactgttgctcatatgcaggcggtaccgcgttgggtcgtttcgggcgg

SEQ ID NO: 443833 - DNA, 245 bp, Homo sapiens
  misc_feature: NA.10.6.A06.2.454.light.2.nb
  modified_base (198)..(198): a, c, t, g, unknown or other
ctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctcngtaccaacacaccagacaaacgccccaaatcaataatcatgatgtac

SEQ ID NO: 443834 - DNA, 320 bp, Homo sapiens
  misc_feature: NA.10.60.F05.2.454.light.2.nb
  modified_base (237)..(237): a, c, t, g, unknown or other
gaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctcaatgatgttggtgttatatctatgtctcctggtaccaacaacacgcaggcaaacgcccccgaagtcatgatttangatgtacagtaacgcggccctcgacggggtccctcgaccgtcttctctggctccagtctggcaacaccggcctccctgaccca

SEQ ID NO: 443835 - DNA, 364 bp, Homo sapiens
  misc_feature: NA.10.63.F08.1.454.light.2.nb
  modified_base (131)..(131): a, c, t, g, unknown or other
  modified_base (170)..(170): a, c, t, g, unknown or other
  modified_base (308)..(308): a, c, t, g, unknown or other
taggacccagagggaaccatggaagccccagctcagcttctcttcctcctgctactctggctcccagaaactaccgcagaaattgtgttgacacagtctccagccaccctgtctttgtctccaggggaaangccaccctctcctgcagggccagtcagagtgtttcccgntacttagcctggtaccaacagaagcctggccaggctcccaggctcctcatgtatgatgcatccaacagggccactggcatcccagccaggttcagtggcaggtgggtctgcgacagacttcactctcaccatcaaacngcctagaacctgaagtattttgactactttattctgtactaccagacgtcgctaac

SEQ ID NO: 443836 - DNA, 405 bp, Homo sapiens
  misc_feature: NA.10.64.F09.1.454.light.2.nb
caggacccagagggaaccatggaagccccagctcagcgtctcttcctcctgctactctggctcccagatataaccgccggagaaattgtgttgacacagtctccagccaccctgtctttgtctccaggggaaagccaccctctcctgcagggccagtcagagtgttagcactaacttagtctggtaccaacagaaacctggccaggcctcccaggctcctcatctatgatgcatccacgagggccactggcatcccagccaggttcagtggcagtgggtctgggacagcttcactctcacatccaccggcctagaccctgaagatttgctagtttattactgtcagcagcgtagcagctggccccctctccctctacgtttcgggcggacgggaccaagggtcgg

SEQ ID NO: 443837 - DNA, 177 bp, Homo sapiens
  misc_feature: NA.10.65.F10.1.454.light.2.nb
  modified_base (154)..(154): a, c, t, g, unknown or other
cagtcaggacacagcatggacatgagggtccccgctcagctcctggggctcctgctactctggctccgaggtgccagatgtgacatccagatgacccagtctccaccgtccctgtctgctatttgtggagacagagtcaccatctcttgccganaagtcagaacttgacactattga

SEQ ID NO: 443838 - DNA, 364 bp, Homo sapiens
  misc_feature: NA.10.68.G02.1.454.light.2.nb
  modified_base (261)..(261): a, c, t, g, unknown or other
caggaggcagagctctgggaatctcaccatggcctggacccctctcctgcctccccctcctcactttctgcacagtctctgaggcctcgtatgaactgacacagccaccctcggtgtcagtgtccccaggacagactgccaggatcagctgctctggagatgcattgaccaaacaaaatatgctttatggtacgagacaaaagccaggccaggcccctgtcttgtgatatatgagacaccaagccgaccctcggaatttcngagacgattctccggctccagctcgagggacagtcgcctcttgactatcaggtcggggcccgagggggtcgagtgaggctagactactacttgtttactcgta

SEQ ID NO: 443839 - DNA, 302 bp, Homo sapiens
  misc_feature: NA.10.7.A07.1.454.light.2.nb
  modified_base (287)..(287): a, c, t, g, unknown or other
taggacccagagggaaccatggaagccccagctcagcttctcttcctcctgctactctggctcccagataccaccggagaaattgtgttgacacagtctccagccaccctgtctttgtctccaggggaaagccaccctctcctgcagggccagtcagagtattaggactcttagcctggtaccaacagaaatatggccaggctcccaggctcctcatctatgaaacatccaatagggccactgccatccctgccaggttcagtgcagtgggtctgggacagacttcnctctcatcatcagcg

SEQ ID NO: 443840 - DNA, 428 bp, Homo sapiens
  misc_feature: NA.10.71.G05.3.454.light.2.nb
  modified_base (299)..(299): a, c, t, g, unknown or other
gctcagttaggacccagagggaaccatggaagccccagctcagcttctcttcctcctgctactctggctcccagacaccaccggagaaattgtgttgacacagtctccagccacgctgtctttgtctccaggggaaagccaccctctcctgcagggccagtcagagtgttcgctacttcggttagggtgtatcaacataaatccggcaggctcccaggctcctcatctttgatgctttcaacacgggcccctggccgtcccaggcaggttcagtggcagtgggtctgggacagacttcnctctcaccatcagcagcctagagcctgaagtattttgctagtttattactgtcagcagcgtgcctacgtttcggcggtaggtcgcctacgtttcgggcggacgggaaccaaaagtagaggtacaaacga

SEQ ID NO: 443841 - DNA, 435 bp, Homo sapiens
  misc_feature: NA.10.72.G06.1.454.light.2.nb
caggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggactttctaatcgcttctctgcctccaagtctggcaacacggcttccctgaccatctccgggctccacgctgaggacgaggctcattattactgcagctcatatacacccagggcactctcgttgatattcggcggagggacctggctgaccgtctacgtcacgcccgaac

SEQ ID NO: 443842 - DNA, 396 bp, Homo sapiens
  misc_feature: NA.10.74.G08.1.454.light.2.nb
taggacccagacggaaccatggaagccccagcgcagcttctcttcctcctgctactctggctcccagataccactggagaaatagtgatgacgcagtctccagccaccctgtctgtgtctccaggggaatgagccaccctctcctgcagggccagtcagagtattagcagcaacttagcctggtaccagcagaaacctggccagtctcccaggctcctcctctatgatgcatccaccagggcccatggtatcccagccaggttccagtggcagtgggtctggggcagagttcactctcacatcagcagcctgcagtctgaggatatgctagtttattactgtcagcagtatactaactggcctctgcgttcggccaaggggaccaggggtaggaaa

SEQ ID NO: 443843 - DNA, 369 bp, Homo sapiens
  misc_feature: NA.10.76.G10.1.454.light.2.nb
taccgacgcagccgccctcagtatctggggccccagggcagagggtctccatctcctgcactgggagcagaaccagcagtcggggcaggttatgatgttcattggtaccgccaggttccaggcacacgcccccagactcctcattaatgataacaacaatcggccctcaggggtctctgaccgattctctgcctccaagtctggcacttctgcctccctggtcatatctggtctccagggtgaggatgaggctgattatactgccccactcctatgacaacagcctgagttatttggctgttcggcggcgggacaagttgaccgtctacgtcagcccaaggcctcgccccctggtcactctcgttcccc

SEQ ID NO: 443844 - DNA, 280 bp, Homo sapiens
  misc_feature: NA.10.77.G11.2.454.light.2.nb
tgctcagttaggacccagagggaaccatggaagccccagctcagcttctcttcctcctgctactctggctcccagattccaccggagaagttgtgttgacacagtctccagccacctgtctttgtctccgaggggaacgccaccctctcctgcagggccagtcagagtcttaggagctccttagcctggtatacaacagaaacctggccaggcctcccaggcctcctcatctatgatgcatccaacggccactggcatcccagccaggttcagtgcagtg

SEQ ID NO: 443845 - DNA, 373 bp, Homo sapiens
  misc_feature: NA.10.79.H02.2.454.light.2.nb
  modified_base (136)..(136): a, c, t, g, unknown or other
cagttaggacccagagggaaccatggaaaccccagcgcagcttctcttcctcctgctactctggctcccagataccaccggagaaattgtgttgacgcagtctccaggcaccctgtctttgtctccgaggggaaangccacgctctcctgcagggccagtcagagtcttagcagcaactacgttgcctggtaccaacagaaacctggccaggcctcccgggctcctcatctatggtacatctagcagggccactggcatcccagacaggttcagtggcagtggtctgggacagacttcactctcaccatcagcagactggagtctgaagtattttgctagtgtattattgtcagcaatatggtagtcactggg

SEQ ID NO: 443846 - DNA, 459 bp, Homo sapiens
  misc_feature: NA.10.80.H03.1.454.light.2.nb
aaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctggtgggggagacagcattgaaagtgaagctgtccactggtaccagcagaggccaggccaggcccctgtactggtcctctatgatgatagtgaccggccctcagggatccctgagccgattctctggctccaactctgggaacacggccaccctgaccatcaccagggtcgaagccggggatgagccgactattatgtcaggtggtggtatttcagttagtattcgagttccgggggttttcgcgggagggaccaaggctgaccgtcctaggtcagcccaaggctcgccccctggtcactctcgttccca

SEQ ID NO: 443847 - DNA, 362 bp, Homo sapiens
  misc_feature: NA.10.82.H05.1.454.light.2.nb
agcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggagcagttccaacattgggaattcttatgtttcctggtaccagcacatccccaggagtcgcccccaaatcctacatatatgaagatgataacgcgaccgtccagggtacttcctgaccgtattctcgtggctccaagtctggcacgtcgccacccgtgggcatcgccgactccagacgtggggacgaggccgtattttacg

SEQ ID NO: 443848 - DNA, 495 bp, Homo sapiens
  misc_feature: NA.10.86.H09.1.454.light.2.nb
ttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccaccctggacatccaccgggctccgaggaccggggacgaggccgattattactgcgcaacttgggactccaacctgactgttggggctttcggcggagggactaagttgaccgtctacgtcagccccccaaggctcgccccctggtcactctcgtccccgccctcctccactactatg

SEQ ID NO: 443849 - DNA, 369 bp, Homo sapiens
  misc_feature: NA.10.88.H11.2.454.light.2.nb
ctgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgtccttaatttaaactggtaaccaacagaaacgtggccaggctcccaggctcctcatctacgaagcatccacagggccactggctcccagccaggttcgatggcaggtgggtcctgggacagacttcactctcaccatcagcagcctggacctagaagatattgactagtttatattgtcagtcagcgtagc

SEQ ID NO: 443850 - DNA, 374 bp, Homo sapiens
  misc_feature: NA.10.9.A09.1.454.light.2.nb
  modified_base (223)..(223): a, c, t, g, unknown or other
  modified_base (233)..(233): a, c, t, g, unknown or other
taggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgcctcgtaagctggtaccaacacaaacctggccaggctcccagcccctnatctatggtncatccaacagggccactggcatcccagccaggttcagtggcagtgggtatgggaacagcttcactctcaccatcatcagcctggagcctgaagatgttgctagtttattactgtacaactatcgtaccgagtcggccgtcc

SEQ ID NO: 443851 - DNA, 422 bp, Homo sapiens
  misc_feature: NA.11.11.A11.1.454.light.2.nb
  modified_base (287)..(287): a, c, t, g, unknown or other
gcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaaacgataaggactatttagcttggtatcagacaaaaccaggacagcctacctaaactgctcatctcctgggcatcctacccgggcacccggagtcccctgaccgattcagtggcagcgggtctgggacagacttcnctctcaccatcagcaacctgcaggctagaagatgtggcagtttatactgtcagcagtatgtgaagctccgtcacgtttcggcggtagggaccgcggtggagatcgagacgaactgtaggctgcaccatctgtctt

SEQ ID NO: 443852 - DNA, 400 bp, Homo sapiens
  misc_feature: NA.11.17.B06.1.454.light.2.nb
agtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaatggtatcagcagaaaccagggaaagcccctgaggtcctgatctatgctgcatccagtttgcagagtggggtcccatcaaggttcagtggcagtggatctgcgacagatttcactctcaccatcagcagtctgacaacctgaaagtattttgactaacttactactgtacaacagtagttacagtaccccgtggacgttcggaccgttaaggaccaaggt

SEQ ID NO: 443853 - DNA, 404 bp, Homo sapiens
  misc_feature: NA.11.21.B10.1.454.light.2.nb
gctcagttaggacccagagggaaccatggaagccccagctcagcttctcttcctcctgctactctggctccagatagcaccggagaaattgtgttgacacagtctccagccaccctgtctttgtctccaggggaaagccaccctctcctgcagggccagtcagagtgttaacagctacttagcctggtaccaacagaaacctggccagactcccaggctcctcatctatgatgcatccaacagggccactggcaccccagccaggttcagtggccagtggtctgggacagacttcactctcaccatcagcagcctagagcctgagtattttgctagtttatactgtcagcagcgtatcgactggatcaccttcggccaagggacacgactaggaaattaaacga

SEQ ID NO: 443854 - DNA, 419 bp, Homo sapiens
  misc_feature: NA.11.25.C03.2.454.light.2.nb
caggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagccgattctctggctccaactctgggaacgcacgccactctgaccatcagcgggacccaggctatggatgaggctgactattattgtcaggcgtgggacagcagcactgcccgttatcgtcttcggaactcgggaccaaggtcaccgtcttgacgtc

SEQ ID NO: 443855 - DNA, 442 bp, Homo sapiens
  misc_feature: NA.11.28.C06.2.454.light.2.nb
gactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagagccaggccaatctccaaggcgtacctaatttataaggtttcaggcggactcgtggggtcccagaccagattcagcggcagtgggtcaggcgctgatttcacactgagaatcagcagggtggaggctagaagagtggtcggggtttattacgtgcagtgcgagggtacaggtgtggccttcgctcgcagttcggcgggacgggaccgaagggtggagaagtacgaaacga

SEQ ID NO: 443856 - DNA, 385 bp, Homo sapiens
  misc_feature: NA.11.3.A03.1.454.light.2.nb
gtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcaggggtccctgaccgtattctctggttccttgtctgacacctcagcctccctggccatcactgggctccagcctgaggatgaggctgattattactgtcagttcctttgactattaaactggatgtggtattcgggcggagggacccacgtaaccgtcctaggtcagcccaaggctgccccctcggtcactctcgtcccacctcctcgtatctctcg

SEQ ID NO: 443857 - DNA, 408 bp, Homo sapiens
  misc_feature: NA.11.31.C09.1.454.light.2.nb
agatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctcctaaattactcatttatccacatctatgcggcctccggggtccccacgattcagtggcagcggtctgggacagatttcactctcacaatcagcagcctgcagactgaagatgtgggtctttattattgtacaaactattattctctttgtttaccgtttaatttcgggacggtaagggaccaagggtggagatacaaaa

SEQ ID NO: 443858 - DNA, 173 bp, Homo sapiens
  misc_feature: NA.11.41.D08.1.454.light.2.nb
gctacaatcggccctactacggtatggacgtctggggccaagggaccacggtcaccgtctcctcagcctccaccaagggcccatcggtcttcccctggcaccctcctccaagagcacctctggggcacagcggccctgggctgcctggtcaaggactacttccgtatctctcg

SEQ ID NO: 443859 - DNA, 452 bp, Homo sapiens
  misc_feature: NA.11.57.F02.3.454.light.2.nb
tgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggacgggccactggcatccccaccaggttcagtggcaggtgggtctggggacagacttcattctcaccatccgcagcctagacgcctagaagtatttgctagtttattactgtacaacagcgtagcagcaggcctccggcgacgttcggccgaagggaccaaggtggaagtcaagcgaactgtcggctgcaccatctgtcttcactctt

SEQ ID NO: 443860 - DNA, 448 bp, Homo sapiens
  misc_feature: NA.11.59.F04.1.454.light.2.nb
aggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgttctctatgatgtcactaagcggccctcaggacgtccctgactcgattctctggctccaagtctggcaacacggcccctccctgaacatctctgggctccaggctgaggatgaggctgattatattgctgctcatatggaatacctacttcttttctcttcggaacttgggaccacggtcaccgtctaaggtcacgcccaacggcccaacccgactcgta

SEQ ID NO: 443861 - DNA, 364 bp, Homo sapiens
  misc_feature: NA.11.60.F05.1.454.light.2.nb
ctcagttaggacccagacggaaccatggaagccccagcgcagcttctcttcctcctgctactctggctcccagataccactggagaaattgtgatgacgcagtctccagccaccctgtctgtgtctccgaggggaaagccaccctctcctgcagggccagtcagagtattagcagcaacttagcctggtaccaacaaaacctggccaggctcccaggctcctcttctatggtgcatccaacagggccgctggtatcccagccaggttcagtggcaggtgggtctgcgacagagttcactctcaccatcagcagtctgcagtctgaagtttttgctagtttatactgtcagcagtataatgactg

SEQ ID NO: 443862 - DNA, 485 bp, Homo sapiens
  misc_feature: NA.11.67.G01.2.454.light.2.nb
actgtgggttgagaagacaggactcaggacaatctccagcatggccagcttccctctcctcctcaccctcctcactcactgtgcagggtcctgggcccagtctgttctgactcagccaccctcagcgtctgggacccccggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcgggcggagggaccaagctgaccgtctgggtcagcccaaggctcgccccctggtcactctcgttccccaccctcctcgtatctctcg

SEQ ID NO: 443863 - DNA, 269 bp, Homo sapiens
  misc_feature: NA.11.67.G01.3.454.light.2.nb
aagacaggactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactggtccacctccaatagtcggggccgttatggtatgctctggtatcaaacaacgtccaggaatcggacccccaaactcctcatctatgctgacaacaatcgaccttcaggggtccct

SEQ ID NO: 443864 - DNA, 398 bp, Homo sapiens
  misc_feature: NA.11.70.G04.1.454.light.2.nb
tctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattattagcctggtatcagcagagaccagggaaacctcctaacctcctgatctttgctgcatccactctgcaatcaggggtccatctcgattcagtgcagtgatctgggacagatttcactctcaccatcagcagcctggcagcctgaagatgttgcaacttattactgtacaaaagataagcgctcgccccgctcagtttcggcggaggaccaaggtcgg

SEQ ID NO: 443865 - DNA, 407 bp, Homo sapiens
  misc_feature: NA.11.73.G07.2.454.light.2.nb
caaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgacaggaaagcccctgagctcctgatctacgatgcgtaccaagtttaggaaacagacggtacccccacggaggttcagtggaaagtggaatctgggacagtactttactctcaccatcagcagcctgcagcctgaagatattgacaacatattactgtacaacagtatgatcgtctcctcaatttcggcccttgggaccagacgttggacaa

SEQ ID NO: 443866 - DNA, 486 bp, Homo sapiens
  misc_feature: NA.11.75.G09.1.454.light.2.nb
tgtgggcacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctcctgcactgggtccacctccaatatcggggccgttatggtatgctctggtatcaacaacgtccaggaatcggacccccaaactcctcatctatgctgacaacaatcgaccttcgaggggtccctgaccggttctctggctccaagtctggctcttccgcctccttggccatcactgggctcgaggctgacgatgaggctgattactactgtctgtcctatgacgacgacctacagtaccggttttcggcggagggactaagctgaccgtcctaagtcagcccaaggctcgccccctgtcactctcgttcccacctcctcgtatctctcg

SEQ ID NO: 443867 - DNA, 198 bp, Homo sapiens
  misc_feature: NA.11.75.G09.2.454.light.2.nb
tctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccaccctcctcgtatctctcg

SEQ ID NO: 443868 - DNA, 389 bp, Homo sapiens
  misc_feature: NA.11.76.G10.1.454.light.2.nb
  modified_base (284)..(284): a, c, t, g, unknown or other
ggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccataagagagatttgttagttggtaccaacagaagccaggccagcctaccaaagcagctcatttatggcatctactcgggattccccggggtccctgaccgattccgtggcngtggatcgtgggacaaatttcactctcaccatcaatagcctgcaggctagaagatgtgcagtcttattattgtcagcaatattatacttctcttcgatctacttt

SEQ ID NO: 443869 - DNA, 421 bp, Homo sapiens
  misc_feature: NA.11.81.H04.1.454.light.2.nb
  modified_base (134)..(134): a, c, t, g, unknown or other
agttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctcccaggctcctcatctatggtgcatccaccagggccactggtactcccagccaggttcagtcggcagtgggtctgggacagggttcactctcaccatcagcagcctgcagtctagaagtattttgcttagtttttactgtcagctagtatagtaactggcctcgtactactttggaccgtaggggaccaagctaagaaactacaaacgact

SEQ ID NO: 443870 - DNA, 401 bp, Homo sapiens
  misc_feature: NA.11.86.H09.1.454.light.2.nb
tgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtggctccagtctgatgatgaggctgattattactgtgcagcatgggatgacacctgaatggtccttgtgttggtttcggcggtagggaccaagctgaccgtctaggtcagcccaaggcctcgccccctcggtcactctcgttccccaccctcctcgtatctctcg

SEQ ID NO: 443871 - DNA, 239 bp, Homo sapiens
  misc_feature: NA.11.86.H09.3.454.light.2.nb
ctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcccctatgacgacgacctacagtctcc

SEQ ID NO: 443872 - DNA, 232 bp, Homo sapiens
  misc_feature: NA.13.10.A10.5.454.light.2.nb
ttatctatggtgcatccaccttacaaagtgggtcccatcaaggttcagtggcactggatctgggacagatttcactctcaccatcagcagtctgcaacctgaagattttgcaacttattactgtcaacagagtttcagtacgcggacgttcggccaagggaccaaggtggaaatcaaacgaactgtggctgcaccatctgtcttcatcttcccgccatctgatagtacgtga

SEQ ID NO: 443873 - DNA, 457 bp, Homo sapiens
  misc_feature: NA.13.11.A11.1.454.light.2.nb
gttaggacccagagggaaccatggaaaccccagcgcagcttctcttcctcctgctactctggctcccagataccaccggagaaattgtgttgacgcagtctccaggcatcgtgtctttgtctcgaggggaaagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttccatcttcccgccatctgatagtacgtga

SEQ ID NO: 443874 - DNA, 279 bp, Homo sapiens
  misc_feature: NA.13.11.A11.10.454.light.2.nb
agagaagacaggattcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtccccagactcctcatcaatagtaaacaaacaagtccggacccccgcacggggtccc

SEQ ID NO: 443875 - DNA, 444 bp, Homo sapiens
  misc_feature: NA.13.11.A11.2.454.light.2.nb
caccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttctcctgaggttcaggtcaaactcagataaacgacagggctcgtggacgtccccagccgcttctctggactccaaggatgattccgccacgcagggatatactcatctctgggctcagtctgacgatgaggctgactattactgtttgacttggacacaacaacgcctggatcgttcggactgggaccacggtcaccgtcaggtcacgcccaaggcccaacccactcgcactctcgtt

SEQ ID NO: 443876 - DNA, 377 bp, Homo sapiens
  misc_feature: NA.13.11.A11.5.454.light.2.nb
agcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggactcccccctgagcgattctctggcctccaactcgtgggaactcagccactctgaccatcagccgggacccaggctagtgatgaggctgactattactgtcaggcgtgggacaggcagcacgtcgcccg

SEQ ID NO: 443877 - DNA, 375 bp, Homo sapiens
  misc_feature: NA.13.11.A11.6.454.light.2.nb
  modified_base (367)..(367): a, c, t, g, unknown or other
agcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttacaaaataccaggccgccctcgtcggggtccctgagcgattcctccccggctccgcctcgtacgggaaccacgtcactctgaccatcagcggacccagcctattgatgaggctgtctacttctgtcaggcgtgggacaacgngcgtgcgt

SEQ ID NO: 443878 - DNA, 342 bp, Homo sapiens
  misc_feature: NA.13.11.A11.7.454.light.2.nb
agcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtgttataactatgtctcctggtatcaacaacacccaggcaaacgccccaaatcatcatttatgaagtcatttatcggccctcaggtatttctaatcgcttctctgctcagtctggcaacacgcctcctgaccatctctgggctccgaggctgaagacgagctgatttatactg

SEQ ID NO: 443879 - DNA, 290 bp, Homo sapiens
  misc_feature: NA.13.11.A11.9.454.light.2.nb
cagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtggacgttcggccatgggaccaaggtggaaatgaaacgaactgtggctgcaccatctgtcttcatcttcccgcatcctgatagtacgtgaa

SEQ ID NO: 443880 - DNA, 191 bp, Homo sapiens
  misc_feature: NA.13.12.B01.2.454.light.2.nb
aggcagcgctctcgggacgtctccaccatggcctgggctctgctattcctcaccctcctcactcagggcatagggtcctgggcccagtctgccctgactcagcctgcctccgtgtctgggtctcctggacagtcatcaccatctcctgcacgtgggaccagcagtgacgttcgtggtcaagctatgtctcc

SEQ ID NO: 443881 - DNA, 188 bp, Homo sapiens
  misc_feature: NA.13.17.B06.1.454.light.2.nb
agagacaacgccaagaactcactgtatctgcagatgaccagcctgagagtcgaggatacggctgtgtattattgtgcgagagatggggcacgacattttgagaggtgtactggggccagggacgccccggtcaccgtctcctcagcctccaccaagggcccatcggtcttcccctggcgccctgctcc

SEQ ID NO: 443882 - DNA, 298 bp, Homo sapiens
  misc_feature: NA.13.27.C05.1.454.light.2.nb
tcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacagtggatcccatcaaggttcagtgcagtaagatctgggaacagtacttttaccc

SEQ ID NO: 443883 - DNA, 388 bp, Homo sapiens
  misc_feature: NA.13.33.C11.2.454.light.2.nb
  modified_base (132)..(132): a, c, t, g, unknown or other
caggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccaggcccctgtggtggtcatctatagggataataaccggccctctgggactccctgaccgattctctggctccccaactcggggaacacggccaccctgacccatcaaacagacgacccaagacggggatgaggctgactattatgtcaggtgtgggacagcaccgacggtgatagtcggcg

SEQ ID NO: 443884 - DNA, 426 bp, Homo sapiens
  misc_feature: NA.13.34.D01.1.454.light.2.nb
tgggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctcctctatttaggtgcatccactagggccacgtggtcgtcccagtcaggttcagcggcagtgggtctggggacagacttcactctcaccatcagcagcctgcagtctagaagtatttgctagtctattactgtcagcagtatagttactggacgtaaccttcggaccgaagggaccaacgacgttagggaagt

SEQ ID NO: 443885 - DNA, 299 bp, Homo sapiens
  misc_feature: NA.13.34.D01.2.454.light.2.nb
  modified_base (287)..(287): a, c, t, g, unknown or other
cagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacagttggggcacattatgatgtacactggtaccagcagtttccaggagcaggtcccagacctcctcatcaaatagtaacaacaatccggcccgcacggggtccctcgaccgattctctggctcnggtctggcacct

SEQ ID NO: 443886 - DNA, 411 bp, Homo sapiens
  misc_feature: NA.13.36.D03.1.454.light.2.nb
gtcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtaggggaaacaacattggaagtaaaagtgtgcactggtaccagcagaagccaggccaggcccctgtgctggtctctatgttgatagcgaccggccctcagggactccctgacgcgattcgtcgggctccaactcgtgggacacggccactctgaccatcagtagggtcgaagccggggatggaggccgatatactgtcaggtgtggggataggtagtcgtgagcatgtggtattcgggcggagggaaccaaacgt

SEQ ID NO: 443887 - DNA, 289 bp, Homo sapiens
  misc_feature: NA.13.37.D04.2.454.light.2.nb
  modified_base (160)..(160): a, c, t, g, unknown or other
aggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagtgatgttggtgttataactatgtctctgtaccaacaacaccaggacaaacgaccccaaaatcatgtattatgatgtcagtaagcggccctcgacgggtccctgactcgcttctctgcctcagtct

SEQ ID NO: 443888 - DNA, 440 bp, Homo sapiens
  misc_feature: NA.13.38.D05.2.454.light.2.nb
ctgggaacacttagccttcatgagtgtccccaccatggcctggatgatgcttctcctcggactccttgcttatggatcaggagtggattctcagactgtggtgacccaggagccatcgttctcagtgtctcctggaggacagtcacactcacttgtggcttgagatacggctcagtctctagtagttactaccccagctggtaccaacagaccccaggccaggctccgcgcacgctcatctacaacacaaaacactcgctcttctcggggtccctccatcgcttctctcggctccactccttggaacaaagctgcccttactcatcgacgggggcccaggcagaagatgaatctgattattactgtgttctttatatgggtatgcctatttctgctgtgtttcggaggtaggcacccggctcgaccgtccgtcggtcacg

SEQ ID NO: 443889 - DNA, 429 bp, Homo sapiens
  misc_feature: NA.13.38.D05.3.454.light.2.nb
acaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtcccctgaccgattcagtggcagcgggtctgggacagatttcactctcaccatcagcagcctgcaggctgaagatgtggcagtttatactgtcagcaatattatagtactcctcgaggctcactttcggcggaggaccaaggtggagactacaaacga

SEQ ID NO: 443890 - DNA, 407 bp, Homo sapiens
  misc_feature: NA.13.38.D05.5.454.light.2.nb
gtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaacgccccgaacctcctgatctacggtacatccactttgcacagtggactcccatccaaggttcagtggcagtagatctggaaacagtattttaccccaccatcaggggtctacagcctgaagtattttgcgtacttactattgtacaacagtacgttaccttctacccccggtacgttcggccgtaaacgggaccgaa

SEQ ID NO: 443891 - DNA, 335 bp, Homo sapiens
  misc_feature: NA.13.38.D05.6.454.light.2.nb
  modified_base (219)..(219): a, c, t, g, unknown or other
caggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaataattatgtatattggtatcagcagctcccaggaaccggcccccaaangctcatctataggaataatcagcggccctcgacggggtccctgaccgattctctggctccccaagtctggcacctcacgccctccctggcccatccagtgggcctccggtcgagga

SEQ ID NO: 443892 - DNA, 432 bp, Homo sapiens
  misc_feature: NA.13.39.D06.1.454.light.2.nb
  modified_base (161)..(161): a, c, t, g, unknown or other
gaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggccaaccggcccccagagtcatcatttatgggggcaagtaggcggccgtcgagggtatttccacctcgcttctctggctcaagtctggcacacggcctcctgacatctctggtctcaggctgaggacgaggctgccctagttactgctgctcatatgctaggttcttctggtcggtcttcgggcggttagggtccaaagttcgaccgttctaaggtcaag

SEQ ID NO: 443893 - DNA, 395 bp, Homo sapiens
  misc_feature: NA.13.39.D06.3.454.light.2.nb
gtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggacaaacgcccccaaatcatcatttatgaagtcatttatcccggccctcagggtatttctaatcgcttctctggctccaagtctggcaacacggcctcctgaccatctctggctccagctgaggacgaggctgcctattacctgctgctcatatgctaggtttcttcgtggtcggt

SEQ ID NO: 443894 - DNA, 121 bp, Homo sapiens
  misc_feature: NA.13.46.E02.2.454.light.2.nb
tcacgtactaggaagtaggccttgaccaggcagcccagggccgctgtgctctcggaggtgctcctggagcagggcgccagggggaagaccgatgggccttggtggagctgaggagacggtg

SEQ ID NO: 443895 - DNA, 400 bp, Homo sapiens
  misc_feature: NA.13.5.A05.1.454.light.2.nb
taactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctcctgcatagaaatggatataactatttggattggtatctgcagaggccagggcacgtccccacaactcctgatctagttggggttctaagtcgggcctccggggtcctaagaggttcagtgcagtggatcgaggcacagtatttacactagaaaatcagcagagtggaggctggaggatggttggggtttattactgcatgcaagct

SEQ ID NO: 443896 - DNA, 351 bp, Homo sapiens
  misc_feature: NA.13.50.E06.1.454.light.2.nb
gctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaggaaatattctgaacaaaaaaatatagctcggtggttccagcagaagccaggccaggccccagtactggtgatttataaagacattgagcggcctcagggatccccctgagcgattctccggctctaattcagggaccacagtcaccttgaccatcgaccggggccagatgagatgagctgactatattgtactc

SEQ ID NO: 443897 - DNA, 421 bp, Homo sapiens
  misc_feature: NA.13.53.E09.1.454.light.2.nb
  modified_base (308)..(308): a, c, t, g, unknown or other
tcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatccccatcaaggttcagtggcaagtagatctggaacagtacttttacccncaccatcgaggggtctacagcctagaagtatttgacgtacttactattgtacaactagtacgttacccttccgtcccccggacgttccggaccgaacgggtaaccgaacgggt

SEQ ID NO: 443898 - DNA, 392 bp, Homo sapiens
  misc_feature: NA.13.55.E11.1.454.light.2.nb
tctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactattgaattggtatcaaacaaaaccaggagagcccctcacctccttatctatggtgcatccaccttacaaagtgggtcccatcaaggttcagtggcactggatctgggacagatttcactctcaccatcagcagtctgcaacctgaagtattttgactaacttattactgtacaacagtagtttcaagtacgcggtacgttcggaccgaaagggg

SEQ ID NO: 443899 - DNA, 351 bp, Homo sapiens
  misc_feature: NA.13.55.E11.3.454.light.2.nb
agaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaatcattattacggggtcaataagcggccctcagggctttctgatcgcttcctctggctccaagtctggcaacacggcctccctgacaatctctgactccaggccgagacgaggctgtattttac

SEQ ID NO: 443900 - DNA, 416 bp, Homo sapiens
  misc_feature: NA.13.59.F04.1.454.light.2.nb
  modified_base (407)..(407): a, c, t, g, unknown or other
tctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttattagcctggtatcagcagaagccagggagagtccctaaattattgatctctgctgcgtccgccttgcaacgtcgggggtccatctcggttcagtggcggtggatctaggacagaattcactctcaccatcaccaacctgcaccctgaagatgttggaagttattactgtcagacctatagtggtggccgctcattttcggcggagggaccgaaagggtcgcgngatcaaacg

SEQ ID NO: 443901 - DNA, 413 bp, Homo sapiens
  misc_feature: NA.13.59.F04.2.454.light.2.nb
  modified_base (404)..(404): a, c, t, g, unknown or other
tctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttattagcctggtatcagcagaagccagggagagtccctaaattattgatctctgctgcgtccgccttgcaacgtcgggggtccatctcggttcagtggcggtggatctaggacagaattcactctcaccatcaccaacctgcaccctgaagatgttggaagttattactgtcagacctatagtggtggccgctcattttcggcggagggaccaaggtcgcgngatcaaacg

SEQ ID NO: 443902 - DNA, 447 bp, Homo sapiens
  misc_feature: NA.13.6.A06.1.454.light.2.nb
caccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctagttggggttctaagtcgggcctccggggtaccctaagaggttcagtggcagtggatcgaggcacagtattttacactagaaaatcagcagagtggaggctagaggtattggttaggggtttatacgtgcatgcaagctactacaacctctgcgactttcggccctgggaccaaagtggagatacaaacgaactgtaggctgcaccattctgtctt

SEQ ID NO: 443903 - DNA, 310 bp, Homo sapiens
  misc_feature: NA.13.60.F05.1.454.light.2.nb
tgtagggccagtcagagtgttaacagcaacttcttagcctggtaccagcagaaacctggccaggctcccaggctcctcatatacggtgtgtccactagggccactgacatcccagacaggttcagtggcagtgggtctgggacagacttcactctcaccatcagcagactggagcctgaagttttgctagtttatactgtcaccagtatggcacctcaccgctcactttcggcggaggaccaaggtggagatacaaacgactgtggctgcacccatctgtctcaatcttcccgcatctgatagtacgtga

SEQ ID NO: 443904 - DNA, 358 bp, Homo sapiens
  misc_feature: NA.13.64.F09.2.454.light.2.nb
caggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggacaagtcagaatattaagacctatttgaattggatcagcaaacaccaagggaaacacccccaaatcctgactcttcggttcatctcgtttgacaaagtggagtcccttcacggttcagtgcagtggatcgtgggacagacttcactctcaccatcgcagtcttacaacgtgacgtactttgctaacgtactactgtacaacagaccta

SEQ ID NO: 443905 - DNA, 349 bp, Homo sapiens
  misc_feature: NA.13.67.G01.1.454.light.2.nb
acaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttctagcttggtaccagcaagaaaccaggacagcctcctaagctgctcatttactgggcatctatccgggaatccggggtccccctgaccgattcagtggcaggcgggtctgggacagatttcactctcacatcagcagcctgcaggctgaagatg

SEQ ID NO: 443906 - DNA, 339 bp, Homo sapiens
  misc_feature: NA.13.71.G05.3.454.light.2.nb
gcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggataaatatgcttgctggtatcagcagaagccaggccagtcccctgtgctggtcatctatcaagataccaagccggccctcgagggactccccctgagcgtattctctggctccaaactcgtagggaaccacacgccactctcgaccatcagccgggacccaggctgtgatggag

SEQ ID NO: 443907 - DNA, 348 bp, Homo sapiens
  misc_feature: NA.13.72.G06.1.454.light.2.nb
accatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccccccagttctcctgaggttcaggtcaaactcagataaacgacagggctctggacgtccccagccgcttctctggactccaaggatgattcccgcaacgcagggatatactcatctctggctcagtctgacgatgaggctgactattactggttt

SEQ ID NO: 443908 - DNA, 423 bp, Homo sapiens
  misc_feature: NA.13.73.G07.1.454.light.2.nb
gttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaattataaggtgtctgacagggactccggggtcccagacagattcagcggcagtgggtcagggcactgatttcacactagaaaatcagcgagggtggaggctgaggatgttattgggctcgtattattgcatgcaagcaacacactggccgtacacttttggccaggggaccaagctaggagataacaatcgaa

SEQ ID NO: 443909 - DNA, 303 bp, Homo sapiens
  misc_feature: NA.13.73.G07.2.454.light.2.nb
gttcaccttctcacaatgaggctccctgctcagctcctggggctgctaatgctctggctcccagataccagatgtgacatccagatgacccagtctccatccctccctgtctgcatctcttggagacagagtcaccgtcacgttggccgggcgagtcacgatattaacactttatttagcctggtatcagcagaagccaggagagtaccctaaattattgatctctgctgcgtccgcttgcaagtcggggtcccatctccggttcagtggcggtggtatctaggacagtacttcactctcacc

SEQ ID NO: 443910 - DNA, 422 bp, Homo sapiens
  misc_feature: NA.13.76.G10.1.454.light.2.nb
gaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggacagataaatatacttcctggtatcagcagaagtcaggccagtcccctgtgctggtcatctatcaagatgccaagcggccctagggactccccctgagcgattctctggctccaactctgggaactcagccactctgaccatcagcggacccaggctagtggatgaggctgactattactgtcaggcgtgggacagcagcactgcccgtatcgtcttcggaactgggaaccaaggtcaccgtcctaacgtcagacccg

SEQ ID NO: 443911 - DNA, 434 bp, Homo sapiens
  misc_feature: NA.13.8.A08.1.454.light.2.nb
tcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatgtaaattggtatcaaacagaagccaggtgaagcccctaagctcctgatctatactgcatccactttgtcaggcgggtcccatccaaggttccgtggcagtggatcgtgggacagatttcactctcaccatcaccagtctgcaacctgaagactgtgactaaacttactactgaccaaacagtaccttaacggaaccttcgtacactttggccaggggaccaggctggagatcaaaacgactgtggctgcaccatctgtt

SEQ ID NO: 443912 - DNA, 411 bp, Homo sapiens
  misc_feature: NA.13.81.H04.1.454.light.2.nb
  modified_base (260)..(260): a, c, t, g, unknown or other
  modified_base (297)..(297): a, c, t, g, unknown or other
aggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataatttatgatttcactaatcggcctcaggtntatctaatcgcttcactcggctccaagtctggcaacncggcctccctgaccatctctgggctccaggcagaggacgaggctgattatactgcggctccgtggacgattagctaccctttatcgtcttcgggactgtgaccaaggtcacgtc

SEQ ID NO: 443913 - DNA, 268 bp, Homo sapiens
  misc_feature: NA.13.81.H04.2.454.light.2.nb
aggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattggaaagtaaaagtgtgcactggtaccagcagaagccaggccaggcccctgtgctggtcgtctatgttgatagcgaccggcctcagggactccctgacgcg

SEQ ID NO: 443914 - DNA, 183 bp, Homo sapiens
  misc_feature: NA.13.81.H04.3.454.light.2.nb
tcagacacactagtgtggccttgttggcttggagctccaggcagaggacgaggctgattattactgcggctcctggacgattagcaccctttatgtcttcgggactgtgaccaaggtcaccgtcctaggtcagcccaaggccaaccccactgtcactctgttcccacctcctctagtacgtga

SEQ ID NO: 443915 - DNA, 417 bp, Homo sapiens
  misc_feature: NA.13.87.H10.1.454.light.2.nb
  modified_base (378)..(378): a, c, t, g, unknown or other
gtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttattagtctggtatcaagcaaaaaccagggaaagtccctaagctcctgatctatgttgcatccatttgcaaagtggggtccatcaaggttcagccggcagtggatcgtgggacagaattcactctcacaatcagcagcctgcagcctagaagatttgactaaactttattactgtacaactagtactttaaatacgtttaacccgtnttaccgagtttcggacggtagggaccaaagggtgaagat

SEQ ID NO: 443916 - DNA, 189 bp, Homo sapiens
  misc_feature: NA.13.87.H10.3.454.light.2.nb
ctcagtcaggacacagcatggacatgaggtccccgctcagctcctggggctcctgctactctggctccgaggtgccagatgtgacatccagatgagccagtctccatccaccctgtctgccgtctcgtcggagacgagggtcaccatctacgttggtcgggacaagtcaagaactagttggactaactt

SEQ ID NO: 443917 - DNA, 424 bp, Homo sapiens
  misc_feature: NA.15.1.A01.2.454.light.2.nb
tcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaatcatgatttatgaggccactaagcgaccctcagggctttctaatcgcttctctggctccaagtctggcaacacggcctccctgacaatctctgggctccaggctgacgcgaggctaaattattactgctgctcatatgaaggttataacactatactattcggcggagggaccaagctgaccgtctgcgtcagcccaaggctgccccctcggtcactctcgttcccaccctcctcgctacgtaaga

SEQ ID NO: 443918 - DNA, 381 bp, Homo sapiens
  misc_feature: NA.15.25.C03.1.454.light.2.nb
gactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttagtttgggtctaacgtccgggcctccggggtcccctgacaggttcagtggcgtgatcgaggcatagtatttacactagaaatcagcagagtggaggctaggaggtacggtttggggtttattacgtgacgtagtacg

SEQ ID NO: 443919 - DNA, 413 bp, Homo sapiens
  misc_feature: NA.15.25.C03.2.454.light.2.nb
gactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggtctaagtccgggcctccggggtccctgacaggttcagtggcagtggatcaggcatagtatttacactagaaatcagcagagtggaggcgtggaggtacggttaggggtttattacgtggtactagttacgacgtaaacgggttacctaaacccgtaaaacccc

SEQ ID NO: 443920 - DNA, 275 bp, Homo sapiens
  misc_feature: NA.15.26.C04.1.454.light.2.nb
ggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtaga

SEQ ID NO: 443921 - DNA, 163 bp, Homo sapiens
  misc_feature: NA.15.27.C05.1.454.light.2.nb
cctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgctacgtaga

SEQ ID NO: 443922 - DNA, 446 bp, Homo sapiens
  misc_feature: NA.15.28.C06.2.454.light.2.nb
gactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaagccccaaaagtcctgatctctgccgcctctactttgcaaagtggggtcccatcaaggttcagccggcagtggatcgtgggacagaattcagtctcaccatcagcagcctgcagcctgacgtattttgactaacttactactgaccaaagtgacaataaataatcaatttcggacggtagggaccaagggtggaagatacaaacgaactgtaggctgcaccatctgtcttcatttccc

SEQ ID NO: 443923 - DNA, 414 bp, Homo sapiens
  misc_feature: NA.15.3.A03.1.454.light.2.nb
  modified_base (239)..(239): a, c, t, g, unknown or other
  modified_base (375)..(375): a, c, t, g, unknown or other
gcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttaacagctccaacaataagaactacttagcttggtatcaagaaaaaccaggacagcctacctaagctgctcatttacnggcatctacccgggaatcccggggtcctgaccgattccagtgcagcggtctggcacagtatttcactctcaccatcagcagcctgcaggctgaagatgtggctagtttatactgtcagcaaatatagtaaaagttntttaccttttacgtttccggcccctggggaaaccctaaa

SEQ ID NO: 443924 - DNA, 478 bp, Homo sapiens
  misc_feature: NA.15.34.D01.2.454.light.2.nb
tgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggtccctgatccgcttctctggctccatccttagggaaacaaagctcgccctcaccatccgacgggggcccaggcagacgatgaatgtagattatcactgcgttcctttagtgtggggcgtggctagtttggggtgttcgggcggaagggaccaaacgtcgaccgtccgtacggtcacgcccaaggcctcgccccctcggtccactctccg

SEQ ID NO: 443925 - DNA, 429 bp, Homo sapiens
  misc_feature: NA.15.49.E05.1.454.light.2.nb
tgctcagttaggacccagacggaaccatggaagccccagcgcagcttctcttcctcctgctactctggctcccagataccactggagaaatagtaatgacgcagtctccagccaccctgtctgtgtctccgaggggaaagccaccctctcctgcagggccagtcagagtattgacagcaagttagcctggtaccagcagaaacctggccagactcccagactcgtcatctttgctacatctgccagggccacgtggcatcccagccacgttccagtggcaggtgggtctggggcagagttcattctcaccatcagcagcctgcagtctgaagtatttgctagtttattactgtcagctagtataatgactggcctcgacgttcggacaagggaccaaggtaggaaactcaaaacgacttgtggctgcac

SEQ ID NO: 443926 - DNA, 437 bp, Homo sapiens
  misc_feature: NA.15.56.F01.1.454.light.2.nb
cctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaatcatgattatgaggacaatgagcggccctgaggggtttctaatcgcttctctggctccaagtctgacaacaccggcctcctgacaatctctgggctccaggctgaggacgagggtgattatactgctgcgcatatagaacgtcccattgttgtacgttttcggcggtagggaccaagctgaccgtctaggtcagcccaaggctcgcccctggtcactctcgttcccaaccctctcgctacgt

SEQ ID NO: 443927 - DNA, 519 bp, Homo sapiens
  misc_feature: NA.15.59.F04.1.454.light.2.nb
gccctaaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgactcgcttctctggctccatccttaggaaacaaagctgccctcaccatcgacgggggcccaggcagatgatgaatctgtttattattgtgtcctatatatgggtgctggctagtttcggtcttcgggcggagggaccaagctgaccgtcctaggtcagcccaaggctcgcccctcggtcactctcgttcccgccctcctcgctaacgtacga

SEQ ID NO: 443928 - DNA, 369 bp, Homo sapiens
  misc_feature: NA.15.67.G01.6.454.light.2.nb
  modified_base (282)..(282): a, c, t, g, unknown or other
cagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaaatccgggaaagcccctaagctcctgatctgtgctgcatccactttacaaagtcggggtcccccatcaaggttcagcggcngtggatctggcacagatttcactctcaccatcagcagcctgcagcctgaaggtatttcgctaacttatactgtactacaagtattac

SEQ ID NO: 443929 - DNA, 443 bp, Homo sapiens
  misc_feature: NA.15.74.G08.1.454.light.2.nb
cagtcaggacacagcatggacatgagggtccccgctcagctcctggggctcctgctgctctggctcccaggtgccaaatgtgacatccagatgacccagtctccttccaccctgtctgcatctgtgggaatagagtcaccatcacttgccgggcagtcagagtattagtacctggttggcctggtatcagcagaaaccagggaaacgcccctaaactcctgatgtataaggcatctagcttagaaagtggggtgccatcaaggttccagcggcagtggaatcgtgggacagaattcactctcaccatcagcaccctgcagcctgatgatttgactaacttattactgtacaacagtaataatagtaattccgtggtacgttcggacctaaagggaccaaagggtaggaaatacgaaacgaactgtaggctgcacatctgtctt

SEQ ID NO: 443930 - DNA, 459 bp, Homo sapiens
  misc_feature: NA.15.76.G10.1.454.light.2.nb
cttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctggacccctgcccgattctcaggctccctccgttcggggcaaagctgccctgacaactgtctggtgtgcagccctgaggacgaggctgactattactgcctactctactttggtgtggctgtgctattcggcggaggaccaagctgaccgtcttaagtcagcccaaggctcgccccctggtcaactctcgttcccacctcctcgctacgtacg

SEQ ID NO: 443931 - DNA, 413 bp, Homo sapiens
  misc_feature: NA.15.8.A08.1.454.light.2.nb
catcactacttctcttcctcctgctactctggctcccagataccactggagaagtagtgatgacgcagtctccagccaccctgtctgtgtcgtccgggggaaagacgccaccctctcctgcagggccagtcagagagttgccgccagtttagcctggtaccaacagaaacctggccagcctcccaggctcctcatctatgctgcatccagttagggacactggtatcccagccaggttcagtggcaggtgggtctggcacagtagttccactctcaccatcagcagcccgagtctgaagtatttgctagtttatactgtcagcaatataacagtgaccattcactttcggcccagggaccaaagtggatatacaaacgaactgtggctgcaccatctgtcttcatccttcccg

SEQ ID NO: 443932 - DNA, 404 bp, Homo sapiens
  misc_feature: NA.15.81.H04.1.454.light.2.nb
  modified_base (171)..(171): a, c, t, g, unknown or other
gcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaccaaattcatgattangagtaactaatcggccctgagggtttctaatcgcttctctggctccaagtctggcaacacggcctccctgaccatctctgggctccaggctgaggacgaggctgattattattgcatctcatatacaaccaacagcactctcgactggtattcggcggaggaccaagctgaccgtctaggtcagcccaaggctcgccccctggcactctcgttcccgccctcctcgctacgta

SEQ ID NO: 443933 - DNA, 456 bp, Homo sapiens
  misc_feature: NA.15.86.H09.1.454.light.2.nb
ctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatagaaagttaagagtgatggcagccacaccgaagggggacggatccccgatcgcttcatgggctccagttctggggctgaccgctacctccaccatctccaacctccagtctgacgatgaggctgagtatcactgtggagagccaacaattgatggccaaggacgggttgggtgttcgggcggagggaccaagctgaccgtctaggcagcccaaggcctcgccccctggtccactctcgttccccacctcctcgctacgtagac

SEQ ID NO: 443934 - DNA, 454 bp, Homo sapiens
  misc_feature: NA.15.86.H09.2.454.light.2.nb
ctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatagaaagttaagagtgatggcagccacaccgaagggggacggatccccgatcgcttcatgggctccagttctggggctgaccgctacctccaccatctccaacctccagtctgacgatgaggctgagtatcactgtggagagccaacaattgatggccaaggacgggttgggtgttcgggcggagggaccaagctgaccgtctaggtcagcccaaggctgccccctggtcactctcgttccccacctcctcgctacgtagac

SEQ ID NO: 443935 - DNA, 323 bp, Homo sapiens
  misc_feature: NA.17.1.A01.1.454.light.2.nb
actcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaaactagggagacgacccctaaactcctgatctatgctgcatccagtttgcagactggggtcccatcgaagttcagcggcagtggatcgtggcacagatttcactctcacatcagcagcctgcagcc

SEQ ID NO: 443936 - DNA, 271 bp, Homo sapiens
  misc_feature: NA.17.1.A01.2.454.light.2.nb
gggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaacgcccccaggacactgatttatgataacaaacaacaaacactcctacggacccctgcccg

SEQ ID NO: 443937 - DNA, 484 bp, Homo sapiens
  misc_feature: NA.17.10.A10.4.454.light.2.nb
gtgagcgcagaaggcaggactcgggacaatcttcatcatgacctgctcccctctcctcctcacccttctcattcactgcacagggtcctgggcccagtctgtgttgacacagccgccctcagtgtctgggcccccggaaggagtcaccatctcttgctctcggaaaccccccatgttggattcaattatgtgtcctggtaccagcaactcccggatcacgcccccaaactcctcatatatagaaagataaataagccgaccctcgacggggttcccctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctggtcactctgttcccaccctcctcctagtctacg

SEQ ID NO: 443938 - DNA, 377 bp, Homo sapiens
  misc_feature: NA.17.11.A11.1.454.light.2.nb
catcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtgggtcaggcactgatttcacactgagaatcagcagggtggaggctgaggatgttggggtttatactgcttgcaaggtacacactggtacacttttggccaggggaccaagctggagatcaaacgaactgtggctgcaccatctgtcttcatcttcccgcatctgactagtctacg

SEQ ID NO: 443939 - DNA, 234 bp, Homo sapiens
  misc_feature: NA.17.2.A02.1.454.light.2.nb
tgatctataaggcatccagtttagaagtgggtcccatcaaggttcagcggcagtggatctgggacagaattcactctcaccatcagcagcctgcagcctgatgatcttgcaacttattactgtcaacagtataatttttatccttggacgttcggccaagggaccaaggtggaaatcaaacgactgtggctgcaccatctgtcttcactcttcccgccatctgactagtctacg

SEQ ID NO: 443940 - DNA, 478 bp, Homo sapiens
  misc_feature: NA.17.21.B10.1.454.light.2.nb
ctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtccccagacagattcagcggcagtgggtcagacactgatttcacactgaaaatcagcagggtggaggctgaggatgtcggggtttactacgtgcatgcgagggtacactcgtggccgttcacgttttcgggccagggggaccaaaacgtggatatcagacgaactgtggctgcaccatctgtcttcatcttcccgcatctgactagtctacg

SEQ ID NO: 443941 - DNA, 463 bp, Homo sapiens
  misc_feature: NA.17.25.C03.1.454.light.2.nb
gtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttccagtggcagtggatctgggacagatttcaatctcaccatcaccactctgcaacctgaggattgtgcaatctactactgtcaacagagttacagttcccctcgctacgtttggccaggggaccaaagttgagatacaaacgaactgtggctgccaccatctgtcttcatcttcccgcatctgactagtctacg

SEQ ID NO: 443942 - DNA, 424 bp, Homo sapiens
  misc_feature: NA.17.26.C04.1.454.light.2.nb
gtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaacgcccctaagctcctgatctttgctgcatccagtttgacaaaggtcggggtccccttcaaggttcagtggcagtggatcgtgggacagatttcactctcaccatcagcagtctgcaacctgaagtattttgactaacttactactgtacaacagagttacaactacccctcggctcactttcggcggagggaccaaggtggagatacaaaacga

SEQ ID NO: 443943 - DNA, 403 bp, Homo sapiens
  misc_feature: NA.17.27.C05.1.454.light.2.nb
ctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggaccagcagaagccaggacaggcccctgtacttgtctatttatggtaagaataacccggcctacgagggactcccagaccccgtattctctggctccgactcaaggaaagacagcttcctgaccatcactggggctcgaggcgaagatgaggctgactattactgtaactcccgggacagcagtgctgaccaggtgtatcggcggagggaccca

SEQ ID NO: 443944 - DNA, 491 bp, Homo sapiens
  misc_feature: NA.17.28.C06.1.454.light.2.nb
  modified_base (173)..(173): a, c, t, g, unknown or other
agctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacngctccggcatctcaactaaactattttgctggtaccagcaattcccaggactccggccccccgactcctcatctatagaaatgatcatcggccctccggggtccctgaccgattctctggctccatgtctggcacctcacgccctccctgaccatcagtgggctccggtccgaggatgaggctgattattactgtgcaccgtgggatgacatcctgaatggtccggtgttcgggcggagggaccaggctgaccgtcctaagtcagcccaaggctcgccccctggtcactctcgttccccaccctcctcctagtctacg

SEQ ID NO: 443945 - DNA, 435 bp, Homo sapiens
  misc_feature: NA.17.29.C07.1.454.light.2.nb
gaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtacccaggcaaagcccccaaatcatgatttatgaggtcagtaatcggccctcaggggtttctaatccgcttctctggctccaagtctggcaacacggcctcctgacccatctctgggctccaggctgaggacgagggtgattattactgcagctacatatagaagtggacagcactctcgtattcggcggtgggaccaagctgaccgtctaggtcagcccaggctcgcccc

SEQ ID NO: 443946 - DNA, 510 bp, Homo sapiens
  misc_feature: NA.17.31.C09.1.454.light.2.nb
agagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccgttctcaggctccctccgttgggggcaaagctgccctgccctttcgggtgcgcagcctgaggatgaggctgagtattactgcttgctctcctatagttggtgttcgggtgttcgggcggagggaccaaggctgaccgtcgtaggtcagcccaaggctcgcccctcggtccactctcgttccccaccctcctcctacgtcttaacgcg

SEQ ID NO: 443947 - DNA, 454 bp, Homo sapiens
  misc_feature: NA.17.33.C11.2.454.light.2.nb
caggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctcccctccttggggcaaagctgccctgacactgtctggtgtgcagcctgaggacgaggctgactattactgcctactctactttggtggtgctgtgctattcggcggagggaccaagctgaccgtcttaaagtcacgcccaaggcttcgccccctggtccactctcgttcccca

SEQ ID NO: 443948 - DNA, 406 bp, Homo sapiens
  misc_feature: NA.17.35.D02.1.454.light.2.nb
agacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatattaataggtggttgcctggtatcagcagaaaccaggaaacgaccctaaggtcctgatatatgagtacttctactttagaaagtggggtcccatcaaggttccagcggcagtggatctgggacagaattcactctcactatcaccagcctgcaacctgatgtatttgactaacttattactgccaacagtatcatcaatctattgtaatttcggtgggaagggaccaaagggttgga

SEQ ID NO: 443949 - DNA, 388 bp, Homo sapiens
  misc_feature: NA.17.36.D03.1.454.light.2.nb
  modified_base (140)..(140): a, c, t, g, unknown or other
ctgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacagggccactggcatcccagccaggttccagtggcaggtgggtctggggcagacttcattctcaccatcagcagcctagagcctgaagtattttgctagtttattactggtcagcagcgtagcaactggctcatcaccttcgg

SEQ ID NO: 443950 - DNA, 430 bp, Homo sapiens
  misc_feature: NA.17.37.D04.1.454.light.2.nb
cctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtgggggaaacaatgttaggaagtaaaactgtgcactggtaccagcagaagccaggccaggcccctgtgctggtcgtctatgatgataccgaccggccctcgagggactcccgtgagcgattctctcggctccaactctgggaaccacgggcccaccctgaccatcggcagggtcgaagccggggatgaggccgatattatgtcaggtgtgggataggtagtagtgatcagtgtggtagttcgggcggagggaccagcgtcgaccgttcgtggtca

SEQ ID NO: 443951 - DNA, 338 bp, Homo sapiens
  misc_feature: NA.17.39.D06.1.454.light.2.nb
  modified_base (144)..(144): a, c, t, g, unknown or other
gaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtggcagcaacttagcctggtatcagcagaacctggccaggctcccaggcctcctcatgtatggtcatcctaccgagggccagtggtctcccagcccaggttcaggtggcaggtggggtctggggacaggtagttctctctcatcatcagcagcctgcagtctg

SEQ ID NO: 443952 - DNA, 385 bp, Homo sapiens
  misc_feature: NA.17.4.A04.1.454.light.2.nb
ctcaccatgaggctccctgctcagctcctggggctgctaatgctctggatccctggatccagtgcggatattgtgatgacccagactccactctctctgtccgtcacccgtggacagccggcctccatctcctgcaagtctagtcagagcctctgcatagtgatggaaagacctattgtattggtacctgcagaaggcaggccagtctccacatctacctaatctatgtaagtttccagtcgattctctggatgccagataggttcagtggcagcgggtcaggcacagatttcacactagaaaatcagccgggtggaggctagaggagtagtttggggtttattacgtgcatgactaaggttatttccgttcgtggtacgttcgg

SEQ ID NO: 443953 - DNA, 374 bp, Homo sapiens
  misc_feature: NA.17.40.D07.1.454.light.2.nb
gctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcacgttccccagaactgtgatctatgaagatactgtcagaccccgtcgggactcccgtgatcggttctcgtcggcctccgtcgactacgttccctaccaactctcgccctccctcaccatctctcggactgacgactgaggacggagggtcgactactac

SEQ ID NO: 443954 - DNA, 379 bp, Homo sapiens
  misc_feature: NA.17.42.D09.1.454.light.2.nb
  modified_base (370)..(370): a, c, t, g, unknown or other
ctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctaggacccctgcccggttcctcacggtcctccctcggttcggggcaaggctgccctcgtacccgtttcgggtcgcgcagcctgaggatgaggctgagtattactgnttgctctcc

SEQ ID NO: 443955 - DNA, 403 bp, Homo sapiens
  misc_feature: NA.17.43.D10.1.454.light.2.nb
taggacccagacggaaccatggaagccccagcgcagcttctcttcctcctgctactctggctcccagatactactggagaaatggtgatgacgcagtctccagccaccctgtctgtttctccaggggaacagccaccctctcctgcagggccagtcagagtgtgagcagcaacttagcctggtatcagcagaacctggccaggctcccaggcctcctcatctatggtgccttccaccgagggccgctggtcgtcccagccagattcgaggggcaggtgggtctggggacaggagttcactctcaccatcagcagcctgcagtctagaagtatttgctagtttatactgtcagtcactataataacgtcggccccggggggagttcggccgaagggaccaaggg

SEQ ID NO: 443956 - DNA, 356 bp, Homo sapiens
  misc_feature: NA.17.44.D11.1.454.light.2.nb
  modified_base (353)..(353): a, c, t, g, unknown or other
caggacacagcatggacatgagggtccccgctcagctcctggggctcctgctactctggctccgaggtgccagatgtgacatccagatgacccagtttccctcctccctgtctgcgtctataggagacagagtcaccatcacttgccgggcaagtcagagcattaacagatatgtaaattggtatcagcaagaaaccagggaaacgcccctaaagttcctgatctatgctgcatccagtttacaaagtgggtcccatcgaggttcagtgcagtggatcgtgggcagtatttcactctcaccatcagcagtgtgcaacctgaagtatttagactaacttactactgtacaacanaat

SEQ ID NO: 443957 - DNA, 417 bp, Homo sapiens
  misc_feature: NA.17.57.F02.2.454.light.2.nb
  modified_base (415)..(415): a, c, t, g, unknown or other
tcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcttaacttttaaatggtatcagcggaaccagggaaaccccctaaactcctgatctatactgcatccaatttgacaaaggtcggggtacccatcaaggttcagtggcagtggatcgtgggacagtatttcactctcaccatcagcagtctgcaactgagtatttgactaacttactactgtacaaacgagggttacacgttaccccgtatacgtttggaccaggggaccaagctagganat

SEQ ID NO: 443958 - DNA, 360 bp, Homo sapiens
  misc_feature: NA.17.6.A06.1.454.light.2.nb
gggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttatacagctccgaacaataagaaatactagcttggtaccagcaagaaaccaggacaacctcctaagctgctcatttactgggcatcgtacccgggaatccggggtcctgaccgattcagtggcagcgggtctggggacagtattcactctcaccatcagcagcctgcaggctgagatgtggctactttattactgtcacctag

SEQ ID NO: 443959 - DNA, 374 bp, Homo sapiens
  misc_feature: NA.17.61.F06.1.454.light.2.nb
cctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttgtacttataactatgtctcctggtaccaacagaacccaggcaaacgcccccaaatcatgatttagagtcagtaatcggccctcgaggggtttctaatccgcttctctggctccaagtctggcaacatcggcctcctgaccatctctgggctccgaggctggaggacgaggctagattattactgcagct

SEQ ID NO: 443960 - DNA, 462 bp, Homo sapiens
  misc_feature: NA.17.62.F07.1.454.light.2.nb
  modified_base (221)..(221): a, c, t, g, unknown or other
aatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattangatacaaacaacaaacactcctggacccctgcccggttctcaggctccctcgttgggggcaaagcctcgcctgaccctttcgggtcgcgcagcctgaggatgaggctgagtattactgcttgctctcctatagtggtgttcgggtgttcggggcggtagggaccaagctgaccgtccgtaggtcagcccaaggctcgcccccttggtcactctcgttccccaccctcctcctacgtctacg

SEQ ID NO: 443961 - DNA, 440 bp, Homo sapiens
  misc_feature: NA.17.75.G09.1.454.light.2.nb
ccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcggccactatccctactggttccaggtgaagtctggccacggcccccaggacactaattatgatgcgaccaacagacactcctgggcgcctggtccgttttcggcctcccgtccgtcggggccaaagctgccctgacccgtaacggggcgcagcctgaggacgaggccgactattatgcctactatcatttgatggtgtcgtctgtccctagttttcggcggcgggaccgagggtcggccgtccgtgggtcagcccaaggctcgccccctcg

SEQ ID NO: 443962 - DNA, 443 bp, Homo sapiens
  misc_feature: NA.17.87.H10.1.454.light.2.nb
agaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccacccagacaaacgcccccaaatcatccttatgaggcactaagcggccctcaggggtttcaatcgcttcgctcggctccacgtctggcagcacggcctcctgacatctctggctccagctgaggacgaggctgattatactgctgctcatattcaagtcgtgtcactatgtagttttggcggtagcaccgaaggtcgaccgtcctaggtcagcccaaggctcgccccctcggtctacc

SEQ ID NO: 443963 - DNA, 417 bp, Homo sapiens
  misc_feature: NA.19.10.A10.2.454.light.2.nb
  modified_base (240)..(240): a, c, t, g, unknown or other
agagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgttanggtgcgtccaccagggccactggcactccccgacaggttcagtggcagtgtgtctgggacagacttcactctcaccatcagcagactggagcctgaagattttgctagtgtattactgtacaacgatatgatgagtcacctccgtggtgacatttggccaggggaccaaggttagaa

SEQ ID NO: 443964 - DNA, 248 bp, Homo sapiens
  misc_feature: NA.19.21.B10.2.454.light.2.nb
acaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacaatcttttaacagttaccaacaatagaaaactacttagcttaggaccagcagagaccaggacagcctctaggctgctcatttac

SEQ ID NO: 443965 - DNA, 401 bp, Homo sapiens
  misc_feature: NA.19.22.B11.1.454.light.2.nb
tgcagacccaggtcttcatttctctgttgctctggatctctggtgtcttcggggacatcgtgatgacccagtctccagactccctggctgtgtctctgggcgagagggccaccatcaactgcaagtccagccagaatatttaacaactccaaataataagaactacttagcttggtccagcagaaaccaggacagcctcctaagatgctctttatggcatctgcccggaatccggggtcctgaccgattcagtggcagcggtctgggacagatttcactctcccatcagcgcctgcaggctgaagatgtggctagtttatactgtcagtctaaattttatagtactcccgtggacgttcggacctaagggaccaaaggtaggaaatacgaaaacgaactgt

SEQ ID NO: 443966 - DNA, 430 bp, Homo sapiens
  misc_feature: NA.19.5.A05.1.454.light.2.nb
gtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacacgacccaacagtaagaactacttggcttggtatcagcagaaaccaggacagcctcctaaactgctcatttatgggcatctacccgggaaattggggccctgtccgattcagcggcagcgtgtctgggacagatttcactctcaccatcagcagcctgcaggctgaagatgtggcggtctattactgtacaaactaatattatagaaaagtccgagggtactttcggccctagggactaaggtggagatcagacgaactgtggctgcaccatctagtcttc

SEQ ID NO: 443967 - DNA, 470 bp, Homo sapiens
  misc_feature: NA.19.57.F02.1.454.light.2.nb
cagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatagttaggcgctcgttaggctggtatcagcagaaagcaagggaaaccccctaagctcctgatctatggtgcatccactttggaaagtcggggtccctaaaggttcagcggcagtggaatctgggacagatttcactctcgccatcagcagcctgcagactgaagtatttgactaactttatttttgtactaaactaggtaccttaaacctaccttttccccctactaccgtttcgggaccgggtaacggggacccgtaaagggtggagatacaaagcgaactgtggctgcacatctgtctta

SEQ ID NO: 443968 - DNA, 312 bp, Homo sapiens
  misc_feature: NA.19.60.F05.1.454.light.2.nb
ttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggcctgcaccatctgtcttcatcttcccgcatctgacacgagagta

SEQ ID NO: 443969 - DNA, 435 bp, Homo sapiens
  misc_feature: NA.19.67.G01.3.454.light.2.nb
caggaagcagagcctggagcatctccactatggcctgggctccactacttctcaccctcctcgctcactgcacaggttcttgggccaactttatgctgactcagccccactctgtgtcggagtcgtccggggaagacggtaaccatctttgcacccacaacagtggcaacattgccagctaattttgtgcagtggtaccagcagcgcccgggcacgttcccccacattgtgatctatgaggataatcaaagccgtctggggtccctgatcggttctcgtggcctccatcgacagctcctccaactctcgccctccctcacccatctctggactgaagactgaggacgaggctgactactactgtcagtcttatgatagccgtggtcagtgtggtcgttcgggacgaggaccaagctacgaccgtcaagtcacgcc

SEQ ID NO: 443970 - DNA, 363 bp, Homo sapiens
  misc_feature: NA.19.67.G01.4.454.light.2.nb
acaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacatttcccacctacaagaacaaaacttctagcctgtaccaacagagaccaggacagcctcctaagttgctcatttactgggcttctacgcgcgaattcggggtccctgaccccgagttccggggcaggcgggtctgggcagtatttcactctcaccatcagcagcctgcaggctagaagatgtggctagtttatactg

SEQ ID NO: 443971 - DNA, 474 bp, Homo sapiens
  misc_feature: NA.19.71.G05.1.454.light.2.nb
  modified_base (171)..(171): a, c, t, g, unknown or other
caggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanactagttaccaaacaatagaaaactcttagcttggtaccagcagagaccaggacagcctctaggctgctcatttacgggcatcgtacccgggatccggggtccctgaccgattcagtggcagcgggtctgggacagatttcactctcaccatcagcagcctgcaggctgaagatgtggcctagtttattattgtacaactaattaattattatacttcgtggtacgttcggaccaaaggggaccaaagggtgaatatcgaagacgaactgtgctgcaccatctgtcttcatccttcccgctat

SEQ ID NO: 443972 - DNA, 309 bp, Homo sapiens
  misc_feature: NA.19.71.G05.12.454.light.2.nb
cctctaacactctccccagtctccagactccctggctgtgtctctgggcgagcggccaccatcaactgcaagtccagccacaatcttttatacagttccaacaatgaaaactacttagcttggtaccagcagagaccaggacagcctcctaggctgctcatttactgggcatcgtacccgggatccggggtccctgaccgattcagtggcagcgggtctgggacagtatttcactctcaccatcagcagcctgcaggctagaagatgtggcctagtttattattgtactaaaactaattaattaattta

SEQ ID NO: 443973 - DNA, 473 bp, Homo sapiens
  misc_feature: NA.19.71.G05.2.454.light.2.nb
caggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttactgggcatcgtacccgggatccggggtccctgaccgattcagtggcagcgggtctgggacagatttcactctcaccatcagcagcctgcaggctgaagatgtggcctagtttattattgtacaactaattaattattatacttcgtggtacgttcggaccaaaggggaccaaagggtgaatatcgaagacgaactgtgctgcaccatctgtcttcatccttcccgctat

SEQ ID NO: 443974 - DNA, 473 bp, Homo sapiens
  misc_feature: NA.19.71.G05.3.454.light.2.nb
  modified_base (171)..(171): a, c, t, g, unknown or other
  modified_base (182)..(182): a, c, t, g, unknown or other
caggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanacagttccaanaatagaaaactacttagcttggtaccagcagagaccaggacagcctctaggctgctcatttactgggcatcgtacccgggatccggggtccctgaccgattcagtggcagcgggtctgggacagatttcactctcaccatcagcagcctgcaggctgaagatgtggcctagtttattattgtacaactaattaattattatacttcgtggtacgttcggaccaaaggggaccaaagggtgaatatcgaagacgaactgtgctgcaccatctgtcttcatccttcccgctat

SEQ ID NO: 443975 - DNA, 422 bp, Homo sapiens
  misc_feature: NA.19.71.G05.4.454.light.2.nb
  modified_base (171)..(171): a, c, t, g, unknown or other
caggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanactagttaccaaacaatagaaaactcttagcttggtaccagcagagaccaggacagcctctaggctgctcatttacgggcatcgtacccgggatccggggtccctgaccgattcagtggcagcgggtctgggacagatttcactctcaccatcagcagcctgcaggctgaagatgtggctagtttatattgtacaataatattattatacttcgtggtacgttcggacctaaagggaccaaggttggatta

SEQ ID NO: 443976 - DNA, 421 bp, Homo sapiens
  misc_feature: NA.19.71.G05.5.454.light.2.nb
caggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttactgggcatcgtacccgggatccggggtccctgaccgattcagtggcagcgggtctgggacagatttcactctcaccatcagcagcctgcaggctgaagatgtggctagtttatattgtacaataatattattatacttcgtggtacgttcggacctaaagggaccaaggttggatta

SEQ ID NO: 443977 - DNA, 421 bp, Homo sapiens
  misc_feature: NA.19.71.G05.6.454.light.2.nb
  modified_base (171)..(171): a, c, t, g, unknown or other
  modified_base (182)..(182): a, c, t, g, unknown or other
caggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanacagttccaanaatagaaaactacttagcttggtaccagcagagaccaggacagcctctaggctgctcatttactgggcatcgtacccgggatccggggtccctgaccgattcagtggcagcgggtctgggacagatttcactctcaccatcagcagcctgcaggctgaagatgtggctagtttatattgtacaataatattattatacttcgtggtacgttcggacctaaagggaccaaggttggatta

SEQ ID NO: 443978 - DNA, 344 bp, Homo sapiens
  misc_feature: NA.19.71.G05.7.454.light.2.nb
  modified_base (171)..(171): a, c, t, g, unknown or other
caggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanactagttaccaaacaatagaaaactcttagcttggtaccagcagagaccaggacagcctctaggctgctcatttactgggcatccgtacccgggaatccggggtccctgaccgattcagtggcagcggtctgggacagatttcactctcaccatcagcagcctgcaggctgaa

SEQ ID NO: 443979 - DNA, 342 bp, Homo sapiens
  misc_feature: NA.19.71.G05.8.454.light.2.nb
caggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttactgggcatccgtacccgggaatccggggtccctgaccgattcagtggcagcggtctgggacagatttcactctcaccatcagcagcctgcaggctgaa

SEQ ID NO: 443980 - DNA, 343 bp, Homo sapiens
  misc_feature: NA.19.71.G05.9.454.light.2.nb
  modified_base (171)..(171): a, c, t, g, unknown or other
  modified_base (182)..(182): a, c, t, g, unknown or other
caggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanacagttccaanaatagaaaactacttagcttggtaccagcagagaccaggacagcctcctaggctgctcatttactgggcatccgtacccgggaatccggggtccctgaccgattcagtggcagcggtctgggacagatttcactctcaccatcagcagcctgcaggctgaa

SEQ ID NO: 443981 - DNA, 350 bp, Homo sapiens
  misc_feature: NA.19.72.G06.1.454.light.2.nb
caagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctcactgggaccgtgtgatgttggacttatacccttgtctcctggtaccaacaactaccccggacaaacgcccccaaactcctgatttagagctcataagcggccctcgaggggtttctgagcgtcttctctcggctccagggctgacaacacggcctacctgacgatctctgggctccgaggctgaggacgaggctgac

SEQ ID NO: 443982 - DNA, 338 bp, Homo sapiens
  misc_feature: NA.19.72.G06.2.454.light.2.nb
gaggcagcgctctcgggacgtctccaccatggcctgggctctgctgctcctcactctcctcactcaggacacagggtcctgggcccagtctgccctgactcattctgcctccgtgtctgggtctcctggacagtcggtcaccatctcctgcactggaaccagcagtgatgttagaaattctaacttgtctctggtacaacatcacccaaataaacgcccccaaactcatcatttatgatgccactaagccgccctcaggggtttctaatcgcttcctctggctccaagtctggcaacacggcctccctgacaatctctgggctcaggctgaggacgag

SEQ ID NO: 443983 - DNA, 457 bp, Homo sapiens
  misc_feature: NA.19.78.H01.1.454.light.2.nb
agaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcacccaaataaacgccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtctatctcttatgtcttcggaactgggaccaaggtcaccgtctaggtcaagcccaaggcccaacccactcgttcacttctcgttcccc

SEQ ID NO: 443984 - DNA, 404 bp, Homo sapiens
  misc_feature: NA.19.78.H01.2.454.light.2.nb
ggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctgtaccaacatcacccaaataaagccccaaatcatcatttatgatgccactaagcggccctcaggggtttctaatcgcttctctggctccaagtctggcaacacggcctcctgacaatcctctgggctccaggctgaggacgaggctgattactactgctgctcatatgcaggtcgtatcttcttatgttcttcggacttgggaccaaggtcaccgtctaggtcagcccaaggcccaaccccactcg

SEQ ID NO: 443985 - DNA, 417 bp, Homo sapiens
  misc_feature: NA.19.85.H08.1.454.light.2.nb
cttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtcgtacaggaatgacaacccggccctacaaacatttcagagacgattttcacctccaggacaacaaatcagcctctctgaccattactgtctccagcctgacgacgaggctgactactactgctcagcctgggacaccacgcctcgctgcttggctttcggcggtagggaccaagctcgaccgtcc

SEQ ID NO: 443986 - DNA, 395 bp, Homo sapiens
  misc_feature: NA.19.86.H09.3.454.light.2.nb
tgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgccccctggtcactctcgttcccaccctcctccacgagacgta

SEQ ID NO: 443987 - DNA, 351 bp, Homo sapiens
  misc_feature: NA.19.86.H09.4.454.light.2.nb
  modified_base (241)..(241): a, c, t, g, unknown or other
aagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatcaacccaaataaacgcccccaaactcatcatttangatgccactaagcggccctcaggggtttctaatcgcttcctctggctccaagtctggcaacacggcctccctgacaatctctggctccagctgaggacgaggctgattac

SEQ ID NO: 443988 - DNA, 249 bp, Homo sapiens
  misc_feature: NA.21.12.B01.1.454.light.2.nb
aggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttatgactatgtctcctggtaccaacaatacccaggacaaacgccccaaactcatcatttatgatgtacagtaa

SEQ ID NO: 443989 - DNA, 360 bp, Homo sapiens
  misc_feature: NA.21.14.B03.2.454.light.2.nb
agtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaacccccctaagctcctgatctatgttgcatccagtttgcaaaggtggggtcccccatcaaggttcagtggcaagtgatcgtgggacagatttcactctcaccatcagcagtctgcaacctgaagtattttgactaacttactactgtacaaacaga

SEQ ID NO: 443990 - DNA, 417 bp, Homo sapiens
  misc_feature: NA.21.15.B04.1.454.light.2.nb
ggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactacttagcttggtaccagcagcaaccaggacaacgtcctaaatgctcatttactggcatctgtccgggaatccggggtcctgaccgattcgtggcagcggtctgggcagatttcactctcaccatcagcagcctacaggctgaagatgtggctagtttattttgtattgactaactattatcgccgtctccgctctacgtttcgggcggtagggaccgaaaggtggaa

SEQ ID NO: 443991 - DNA, 231 bp, Homo sapiens
  misc_feature: NA.21.20.B09.1.454.light.2.nb
aataggggtaggtcccctgtggaaaaagggtcagaggccaaaggatgggaggggtcagggacagatttcacactgagaatcagccgggtggaggctgaggatgttggggtttattactgcatgcaaagtgtgcaaattccgtacacttttggccaggggaccaagctggcgatcaaacgaactgtggctgcaccatctgtcttcatcttcccgccatctgacgagcgacga

SEQ ID NO: 443992 - DNA, 477 bp, Homo sapiens
  misc_feature: NA.21.22.B11.1.454.light.2.nb
gggagggggtctgatttgcatggatggactctcccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaataattatgtattctggtatcagcaactcccaggaactcggacccccaaatcctcatccagaggaataatcagccggccctcgaggggtccctgaccgattctctggctccaagtctggcacctcagccctcctgacccatcagtgggctccggtcgagatgaggctgactattactgtgcatcgacgggacgcaacagtgggatgaac

SEQ ID NO: 443993 - DNA, 311 bp, Homo sapiens
  misc_feature: NA.21.25.C03.3.454.light.2.nb
aacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcgggaccagctgaccgtctaggtcagcccaaggctcgcccctcggtccactctcgttccccgccctcctccgcgcgacga

SEQ ID NO: 443994 - DNA, 403 bp, Homo sapiens
  misc_feature: NA.21.26.C04.1.454.light.2.nb
gctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgtggcaacaactacttagcctggtaccagcagaaacctggccaggctcccaggctcctcatccatactgcctccaagacggccactggcatccctgacaggttcagtggccagtgggtctgggacagacttcactctcaccatcaccagactggagcctgatgtatttgctagtttatactgaccaccaacatgctttcgcaccgctcacgttcggcggagggaccgaggg

SEQ ID NO: 443995 - DNA, 375 bp, Homo sapiens
  misc_feature: NA.21.27.C05.2.454.light.2.nb
gctcagttaggacccagacggagccatggaagccccagcgcagcttctcttcctcctgcttctctggctcccagacaccactggagtgattgtgatgacgcagtctccagccaccctgtctgtgtctccgaggggggacccgccaccctctcctgcacagccagtcagtctatcgctgactggttagcctggtaccagcagaaatctggccaggcctcccaggctcctcatttaccgtgcatccaccgagggcccacgtggtcgtcccagacaggttccaggtggcggtggatttgggactagtagttttctctcaccatcagcgccctacagagtgaagatgttgctagtttattctgccagctaatataatta

SEQ ID NO: 443996 - DNA, 440 bp, Homo sapiens
  misc_feature: NA.21.38.D05.1.454.light.2.nb
gagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagtattttgctagtgtattactgtcagatgtatggtagtcacgtacacgtttggccaggggaccaagggtgagatcgagacgaactgtaggctgcaaccatctgtcttcac

SEQ ID NO: 443997 - DNA, 360 bp, Homo sapiens
  misc_feature: NA.21.4.A04.2.454.light.2.nb
  modified_base (227)..(227): a, c, t, g, unknown or other
taggacccagagggaaccatggaaaccccagcgcagcttctcttcctcctgctactctggctcccaggctcagaaaccaccggagaaattgtgttgacgcagtctccaggcaccctgtctttgtctccgaggggaaagccaccctctcctgcagctccagccagaatatccagagctactacatagcctggtaccagcagaagcctggccaggctcccaggttcctnatctatgctgggtcccagagggcccacgtggcatcccagacaggttcagtggcagtgggtctgggacagacttcactctcatcattagcagactggagctgaagtattcgctagtgtattactgtcagcagta

SEQ ID NO: 443998 - DNA, 326 bp, Homo sapiens
  misc_feature: NA.21.40.D07.2.454.light.2.nb
tcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctcctggccatcagtggctccggtcgaggatgaggctgattattactgtgcagcatgtgatgacgctgagtggtccggtgttcgggcggagggaccaggctgaccgtctaggtccagccaaggctcgccccctggtcactctcgttccccaccctcctccgagcgacga

SEQ ID NO: 443999 - DNA, 401 bp, Homo sapiens
  misc_feature: NA.21.47.E03.1.454.light.2.nb
  modified_base (282)..(282): a, c, t, g, unknown or other
tcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccagttgcaaagtggacgtcccgtagaaggttcagcggcnggtgggtctggggacgtatttcaatctcacatcaccagcctgcagcctgaagtattttgactaactttattattgtacaactaggacttaaactgtttacctctactacgttcggcgga

SEQ ID NO: 444000 - DNA, 295 bp, Homo sapiens
  misc_feature: NA.21.52.E08.1.454.light.2.nb
aacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttatttttacacgccccaaccaataagagctactagcttggtccagcacaaaccaggacagcctcctgtaatgctctatttacgtgggctcgtacccggatagtcggggtccctgaccgattcagtggc

SEQ ID NO: 444001 - DNA, 422 bp, Homo sapiens
  misc_feature: NA.21.65.F10.1.454.light.2.nb
gttaggacccagacggaaccatggaagccccagcgcagcttctcttcctcctgctactctggctcccagaaagctctggagaaatagtgatgacgcagtctccagccaccctgtctgtgtctccaggggaagagccacctctcctgcagggccagtcagagtgttagcagcaacttagcctggtaccagcaagaaacctggccagccctcccaggcctcctcatctatggtgcatccgccagggccacgtggaactcccagccaggttcagtggcacgtgggtctggggacaggagttcactctcaccatcagcagcctgcagtctgaagtattttgaagtttattctgttctgctagtacaatcagtggcctcggacgttcggacgaagggaccaagggtaggaaactacgaaacgaacgt

SEQ ID NO: 444002 - DNA, 235 bp, Homo sapiens
  misc_feature: NA.21.71.G05.1.454.light.2.nb
aagatgagctggaggaccgcaataggggtaggtcccagacagaatcagcggctttgggtcaggctctgatttcacactgaacatcagcagggtggaggctgacgatgttggctattttatttttgcatgcaaaatacagactggccttggacgttcggcctggggaccaggttggaaatcaaacgactgtggctgcaccatctgtcttcatcttcccgcatctgacgagcgacga

SEQ ID NO: 444003 - DNA, 357 bp, Homo sapiens
  misc_feature: NA.21.76.G10.2.454.light.2.nb
cagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcggtcaggacattagacattattagcctggtatcagcagaaaccaggtaaagttcccaagctcctgatctatgctgcatcctctttgccaatcaggggtcccatctcggttcagtggcagtggatcgtgggacagatttcactctcaccatcagcagcctgcagcctgaagatgttgcaacttattactagtacaaaaatata

SEQ ID NO: 444004 - DNA, 440 bp, Homo sapiens
  misc_feature: NA.21.81.H04.1.454.light.2.nb
aggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttagactatgtctcctggtaccaacaatacccaggcaaacgcccccaaactcatcatttatgatgtcagtaatcggccctcaggggtttctaatcgcttctctcggctccaagtctggcaaccggcctccctgaccatctctgggctccaggctgatgacgaggctgattatactgcaggtcatatacaatcagcaaactacttatgtcttcgggaactgggaccaagactcaccgtcttaggttcaacgcccaaggcccaccc

SEQ ID NO: 444005 - DNA, 478 bp, Homo sapiens
  misc_feature: NA.21.87.H10.1.454.light.2.nb
caagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaactgtctctggtatcaacaacaccaggacaaagccccaaaactcttaatttctggctcaatcagcgaccctcacatgtttccagtcgattcctctgcatccaagtctggcaacacggcctttctgacaatctctcaactccaggctgaagacgagctatttattactgctcctcatacgcaggtgctacttatttttcgttggttttggcggcgggacccagatgactgtcctcagtcagcccaaggcctcgccccctggtcactctcgttccccgccctcctccgagcgacga

SEQ ID NO: 444006 - DNA, 211 bp, Homo sapiens
  misc_feature: NA.22.11.A11.2.454.light.2.nb
gaattctgtcccatcaaggttcagcggcagtggatctgggacagaattcactctcaccatcagcagcctgcagcctgatgattttgcaacttattactgccaacagtataatacttattcgtggacgttcggccaagggaccaaggtggaaatcaaacgaactgtggctgcaccatctgtcttcatcttcccgccatctgaacgcgtatgt

SEQ ID NO: 444007 - DNA, 434 bp, Homo sapiens
  misc_feature: NA.22.14.B03.1.454.light.2.nb
aggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttacttagcttggttccagcagaaaccaggacatcgtcctgcactgctcatttactgggctctacccgggaatccggggtccctgaccccgattcagtggcagcgggtctgggacagatttcactctcaccatcagcagcctgcaggctgaagatgtggctagtttatattgtcagcaattattatattcctctcagtacgttcggaccaaagggaccaaggtgaaatacaaaacgaactgtacgg

SEQ ID NO: 444008 - DNA, 403 bp, Homo sapiens
  misc_feature: NA.22.15.B04.1.454.light.2.nb
  modified_base (384)..(384): a, c, t, g, unknown or other
aggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacaccaggcaaagcccccaaatcatgatttatgaggtcactaagcggccctcgagggtccctgatcgcttctcctggctccaagtctggcaacacggcctccctgacccgtctcgtcgggctccgaggctggaggatgaggctgattatactgcagctcatatggagcagcgactaagtttgngttcggcggaggaccaagc

SEQ ID NO: 444009 - DNA, 429 bp, Homo sapiens
  misc_feature: NA.22.21.B10.1.454.light.2.nb
cagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctctggtaccaacaccaccaggcacacgacccccaaactcatgatttagagtcactaagcggcctcgacggggtccctgactcgcttctctcggctccaagtctggccgacgccggcctccctgacccgtctcgtgggcctccgaggctgaggatgaggctgattatactgctactcatatgcaggcggcaactcgttggggtgttcggcggaggggaccaaggctcggaccgtccaggtcagccc

SEQ ID NO: 444010 - DNA, 261 bp, Homo sapiens
  misc_feature: NA.22.21.B10.2.454.light.2.nb
cccagcctgcctccgtgtctggatcatctggacagtcgatcagcatttcctgcactgggaccaacagtgacattgggtcttttgactctgtctcctggtaccaacaacacccagcaaaccccccatcatcattatggtgtcactcgtcggccctcaggatctctcatcgcttctcaggctccaagtctggcaacacgcctccctaaccatctctggctccagttgagacgagtctacttattactgcagttactttaaatt

SEQ ID NO: 444011 - DNA, 428 bp, Homo sapiens
  misc_feature: NA.22.25.C03.1.454.light.2.nb
cagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggccagtcagagtattagtgtctgggtggcctggtatcagcagaaaccagggaaagcccctaaggtcctgatctatgaggcatctaactttaaaactggtgtcccatcaaggttccagcggcagtgatctggggacagaattcactctcgccatcagcagcctgcagcctgatgattctgacaactttattactgaccaactagtattatagttagtcgggggtacgttcggaccgaaggggacctaagggtacggaaacttacgaaaacg

SEQ ID NO: 444012 - DNA, 245 bp, Homo sapiens
  misc_feature: NA.22.27.C05.1.454.light.2.nb
caggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctactagcttggttccagcagaaaccaggacatcctcctctactgctctattta

SEQ ID NO: 444013 - DNA, 499 bp, Homo sapiens
  misc_feature: NA.22.28.C06.1.454.light.2.nb
gctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagcggccctcgaggggtccctgaccgattctctggctctaagtctggcacctcggcctccctggacatcagtggcctccggtccgaggatgaggctgattattactgtgcagcatgggattacaacctgagtgatcctagttgggtgttcgggcggagggaccaggctgaccgtcctaggtcagcccaaggcctcgccccctcggtcactctcgttccccgccctcctcacgcgtatgttgt

SEQ ID NO: 444014 - DNA, 453 bp, Homo sapiens
  misc_feature: NA.22.30.C08.1.454.light.2.nb
tggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaaagattggcctatttggcagccaccacgaagggggtcggatccctgatcgcttctcgggctccagctcgtcggggccgagcgctacctcacctctccagcctccagtctgaagatgaggctgactattactgtcagacagtgggacgcgtggcgtctgggctggttcggcggagggaccaagctgaccgtctaggttcagcccaaggctcgccccttggcactctcgtcccacc

SEQ ID NO: 444015 - DNA, 220 bp, Homo sapiens
  misc_feature: NA.22.34.D01.1.454.light.2.nb
agactgacggtcctgccacaggtggtgctgaggaagagatggaggtggacgtgtcagcacccagctggggcctgtccctggggccagggaaccctggtcaccgtctcctcagcctccaccaagggcccatcggtcttcccctggcgccctgctccaggagcacctccgagagcacagcggccctgggctgcctggtcaaggactacttccacgcgtatgt

SEQ ID NO: 444016 - DNA, 447 bp, Homo sapiens
  misc_feature: NA.22.38.D05.5.454.light.2.nb
gctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagcctggtaccagcaaaagcctggccaggctcccagactcctcatctctgatacataccaaacgagggccaacgtggcactcccagccaggttcagtggcaggtcggtctgggacagacttcactctcaccatcagcgacctagacgcctagaagtatttgctagtttattactgtcagcagcgtagcatctggcctccgtactaccgtttggccgaggggaccaaggctaggagatacaaaacgaactgtacggcttgcacc

SEQ ID NO: 444017 - DNA, 306 bp, Homo sapiens
  misc_feature: NA.22.41.D08.2.454.light.2.nb
ggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaatgaagattggcctagtttggcagccaccacgaagggggtcggatccctgatcgcttcgtcgggctccagctcgtcggggccagcgctac

SEQ ID NO: 444018 - DNA, 335 bp, Homo sapiens
  misc_feature: NA.22.46.E02.1.454.light.2.nb
aggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaacgcccccaatcttaattttgtgtcaactaacccgccctcaggggtccctgactcgcttcctccggctcaagtctggcacacggcctccctgaccatctctggactccaggctgacg

SEQ ID NO: 444019 - DNA, 207 bp, Homo sapiens
  misc_feature: NA.22.46.E02.3.454.light.2.nb
  modified_base (168)..(168): a, c, t, g, unknown or other
gggtcctgggcccagtctgccctgacccagcctgcctccgtgtctggatcatctggacagtcgatcagcatttcctgcactgggaccaacagtgacattgggtcttttgactctgtctcctggtaccaacaacaccacggaccaaaccccccatcatcatttatggtntcactcgtcggccctaggagtctctcatcgccttctcag

SEQ ID NO: 444020 - DNA, 425 bp, Homo sapiens
  misc_feature: NA.22.5.A05.1.454.light.2.nb
  modified_base (190)..(190): a, c, t, g, unknown or other
taggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaanagaaacctggccaggctcccaggctcctcatctatgatgcatcttacagggccatggcatcccagccaggttcagtggcaggtgggcctgggacagacttcactctcaccatcagcagcctagagcctgaagatttgctagttattactgtcagcagcgtagcaactcctacgttcggcggagggaccaaaggtggaagatacgaaaacgaactgtaggctgcaccatctgtctt

SEQ ID NO: 444021 - DNA, 432 bp, Homo sapiens
  misc_feature: NA.22.65.F10.1.454.light.2.nb
caggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccaggaaacgcccctaagctcctgatctatgctacttccagtttgacaaagtggggtcccgtaaggttcagtggcagtggatctgggcagatttcactctcaccatccgcggtctgcaacctgaagtatttcgactaacttactactgtacaaacagtacttacagtcgccccccgatccaccttcgccaagggacacgactggagacttaaacgaactgtgctgcacatctgttcttca

SEQ ID NO: 444022 - DNA, 171 bp, Homo sapiens
  misc_feature: NA.22.66.F11.1.454.light.2.nb
gctactggggcttcttcccatggacgtctggggcaaagggaccacgatcatcgtctcctcagcctccaccaagggcccatcggtcttccccctggcaccctcctccaagagcacctctgggggcacagcggccctgggctgcctggtcaaggactacttccacgcgtatgt

SEQ ID NO: 444023 - DNA, 428 bp, Homo sapiens
  misc_feature: NA.22.73.G07.1.454.light.2.nb
taggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacacttagtctggtaccagcagagacctggccaggctcccaggctcctcatctatggttttctaccagggccatggtactccccgcaggttcagtgccccagtgggtctggggacaggagttcactctcaccatcagcagcctgcagtctgaagattttgctactttatactgtcagctaatataatgactggttctgatcaccttcggaccaagggacacgactggaacgattaaacgaactgtaagctagcacatct

SEQ ID NO: 444024 - DNA, 448 bp, Homo sapiens
  misc_feature: NA.22.86.H09.2.454.light.2.nb
  modified_base (317)..(317): a, c, t, g, unknown or other
aggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccaggcaaagcccccagactcatcatttatgctgtcaataagcggccctcgaggggtcccctgatcgcttctctggctccaagtctggcaacacggcctccctgaccntctctgggctccaggctagaagatgaggctgattattactgctgctcatttgcaggcgcctacacttgggtgttcgggcggagggccaagctgaccgtccaggtcagcccaaggctcgccccctggtcact

SEQ ID NO: 444025 - DNA, 361 bp, Homo sapiens
  misc_feature: NA.25.12.B01.1.454.light.2.nb
actcagtctccactctccctgcccgtcgcccttggacagtcggcctccttctcctgcaggtctagtcacaacctcgtacacagtgatgggaacacctacttgaattggtttcagcagaggccaggccaatccccaaggcgcctaatctataaggcttctaaccgggactctggggtccccgacagattcagcggcagtgggtcaggcactgattcacactgaaaatcagcagggtggaggctgaggatgttggggtttattactgcatgcaaggtacacacctggccttccactttcggccctgggaccaaagtgatatacaaacgactgtgctgcaccatctgtcttcatccttcccgcc

SEQ ID NO: 444026 - DNA, 435 bp, Homo sapiens
  misc_feature: NA.25.15.B04.1.454.light.2.nb
actcctcagttcaccttctcacaatgaggctccctgctcagctcctggggctgctaatgctctgggtcccaggatccagtggtgatgttgtgctgactcagtctcccctctccctctccgtcacccttggacagccgcctccatctcctgcaagtctagtcaaagcctcgtctacattgacggaaacacctacctgcattggttccagctgaggccaggccaatctccaaggcgcctaattaataaggtttctaaccgggactcggggtcccagacagattcagcggcagtgcgtcaggcactgatttcacactgaaaatcagcagggtggaggctgaggatggttggggtttattacgtgcatgacaaggcacacacgtggtcctttcgcgtttgggccctgggacgagagtggatatcaagtacgaactgtgg

SEQ ID NO: 444027 - DNA, 402 bp, Homo sapiens
  misc_feature: NA.25.20.B09.1.454.light.2.nb
ggggagagagacccctcccctgggatcctgcagctcctgcctccgtgtctgggtctcctggacagtcgatcaccatttcctgcactggactcagcactgatgttgcaggttattactttgtctcctggtaccaacaacacccaggcaaacgcccccaaattatcatttatgaggccactaagcggccctcaggagtttctaatcgcttctctggctccaagtctggcagcacggcctccctgacaatctctgggctccaggctgaggacgaggctgattattactgctactcatatggacacatcacaaatcccgtcttcggacctgggaccagggtcaccgtctgggtcagcccaaggccaaccccactcgtcactctgttcccgccctcctcactgtaca

SEQ ID NO: 444028 - DNA, 444 bp, Homo sapiens
  misc_feature: NA.25.22.B11.1.454.light.2.nb
  modified_base (235)..(235): a, c, t, g, unknown or other
gcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtcttaataactatgtctcctggtcccaacaacacccaggcaacggccccaaactcatcatttangatgtcagtcatcggccctctggtagtttctggtcgcttcctctggctccaagtctggcaactcggcctccctgaccatctcggggctccaggctgaggacgaggctacttattatgctatttcatacagagacaccaacagtctggtgttcggcggaggaccaaggttcgaccgtctcggtcacgcccaaggctcgcccctggtccac

SEQ ID NO: 444029 - DNA, 398 bp, Homo sapiens
  misc_feature: NA.25.23.C01.2.454.light.2.nb
  modified_base (136)..(136): a, c, t, g, unknown or other
  modified_base (164)..(164): a, c, t, g, unknown or other
gtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaattagttgtctactggtaccagcagctcccagaaacggcccccaagctcctcatctataggaatgatcagcggccctcgagggactacctgaccgattctctggctcgaagtctggcctcctcggcctccctggccatcagtgggctccggtccgaggatgaggctgaatattactgtgctaggtttgggattgggccagtctgagtggtccgaggt

SEQ ID NO: 444030 - DNA, 312 bp, Homo sapiens
  misc_feature: NA.25.23.C01.3.454.light.2.nb
  modified_base (252)..(252): a, c, t, g, unknown or other
caggattcaggacaatctccagcatggcctggtctcctctcctcctcaccctcctcgctcactgcagggtcctgggcccagtctgtactgactcagccaccctcagtgtctgggaccccaggcgagagggtcaccatctcctgcactggggacagttccaatatcggggcaccttataatgttcactggtatcaacaacttccagggacacgcccccaaactcgtcattcatgctgataacaatcgtccctnaggtgtccctgaccgattctccccggcctccaagtctggcactcagcctcctgtcatcac

SEQ ID NO: 444031 - DNA, 411 bp, Homo sapiens
  misc_feature: NA.25.27.C05.1.454.light.2.nb
ccagtcaggacacagcatggacatgagggtccccgctcagctcctggggctcctgctgctctggctcccaggtgtcaaatgtgacatccagatgacccagtctccttccaccctgtctgcatctgttggagaccgagtcaccatgacttgccgggccagtcagacgattagtagctggttggcctggtatcagaagaaaccagggaaacgcccctacaactcctgatctataaggcatctaactttaaaaagtggtagtcccatcaagattcagccggcagtggatcgtgggacagaattctctctcacatcgacagcctgcagcctgatgtattttgactaactttattactgaccctaaactacttaattaaagtactttttacaatttcactttcggaccttgggacc

SEQ ID NO: 444032 - DNA, 435 bp, Homo sapiens
  misc_feature: NA.25.28.C06.1.454.light.2.nb
tctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacgttggccgggcgagtcagggcattggaaattgttggcctggtatcagcaagaaaccagggaaattcctaactcctacatctatgctgcatccactttgctaagtttggggtcccttcgattcagcggcagtgggtctgggacagaattcactctcaccatcagcagcctgcagcctgaagtatgttgctaacttattactgtacaaaatttgaacaagtgaccgtgagtcgttcgacccgagggaccgaaggtgggaaccagtacaaaacgtaacgttgtaac

SEQ ID NO: 444033 - DNA, 266 bp, Homo sapiens
  misc_feature: NA.25.30.C08.3.454.light.2.nb
  modified_base (225)..(225): a, c, t, g, unknown or other
cctgcagggccagtcagagtgttggccgcaactacttagcctggttccagcagaaaactggcgagactcccagactcctcatccatggtgcatccagcagggccactggcattccagacaggttcagtggcagtgggtctgggacagacttcactctcaccatcatgagactggagcctgaggattctgcagtgtattactgtcagcagtatgctagttcacctntgacgttcggaccaaagggaccaaggtgaaatcgaaaacga

SEQ ID NO: 444034 - DNA, 470 bp, Homo sapiens
  misc_feature: NA.25.34.D01.1.454.light.2.nb
cagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggcttactttgaccttgtctcttggtaccaacaacacccggacaaaggctaccaaactcataattttgagaccagtaagcgccctctggggtttctagtcgattcactggctccaagtctggcaacacggcctccctaacaatctctgggctccaggctgaagacgaggctgtttattctgctgttgctatgtggctagaaaactagtttggtgcgtcgggcggagggaccctaagttcgaccgtcttaaagtcagcccaaggctgcccccttggttccaactctcgttcccacccttcctc

SEQ ID NO: 444035 - DNA, 361 bp, Homo sapiens
  misc_feature: NA.25.34.D01.3.454.light.2.nb
  modified_base (292)..(292): a, c, t, g, unknown or other
gcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggaccagcagaagccaggacacggcccctgtacttgcatctataggtaaaaacaccggccctacgacgggactcccagaccgattctcctcggctccagctacaaggaacncagtccttcctgaccatcacgtggggctcgaggcgaagatgaggctgactattactgtaacgtcccggg

SEQ ID NO: 444036 - DNA, 335 bp, Homo sapiens
  misc_feature: NA.25.35.D02.2.454.light.2.nb
  modified_base (179)..(179): a, c, t, g, unknown or other
aggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgattcttggtncttatgacactgtctcctggcaccagtttacccaggaaaacgcccccagagtcatcctttatgatgtcaggaagcggccctcgaggggtccctgactcgcttctctggtccaaatctggcaacacgcctcctgaccatctctggctccagctgaga

SEQ ID NO: 444037 - DNA, 282 bp, Homo sapiens
  misc_feature: NA.25.35.D02.3.454.light.2.nb
  modified_base (239)..(239): a, c, t, g, unknown or other
aggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctgtcccaacaacaccagcaacggcccccaaatcatcatttatngatgtcagtcatccggccttgtagtttcgtggtcgtccttctc

SEQ ID NO: 444038 - DNA, 316 bp, Homo sapiens
  misc_feature: NA.25.36.D03.10.454.light.2.nb
caggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcacctagtttacccaaggaaaacgcccccagacgtcatcctttatgatgtcaggaagcggccctcgacggggtccctgactcgcttctctgggtccaaatctggcaacacggcctcc

SEQ ID NO: 444039 - DNA, 209 bp, Homo sapiens
  misc_feature: NA.25.36.D03.11.454.light.2.nb
atcccgggctcagtctgccctgactcagcctcgctcagtgtccgggtctcctggacagtcagtcaccatctcctgcactggaaccagaagtgatcttggtgcttatgacactgtctcctggcaccagttttacccaggaaaagcccccagagtcatcctttatgatgtcaggaagccggccctcgacggggtccccctgatcgcttctc

SEQ ID NO: 444040 - DNA, 405 bp, Homo sapiens
  misc_feature: NA.25.36.D03.5.454.light.2.nb
gctgtgggtagagaagacaggactcaggacaatctccagcatggccagcttccctctcctcctcaccctcctcactcactgtgcagggtcctgggcccagtctgtgctgtctcagcccaccctcagtgtcgtcgggggccccccgggcaggagggtcgacatctcttgttctggaagtcgctccaacgtcggcagtaatagtgtaagctggtaccagcaactcccaggaaccgcccccacactcctcatgtatgggaatgatcagccgcccctcgacggggtcccctgacccgtattcctctgccctccacgtctggcacctcacgccctccctgccatccgtggctcaatctgagatgaggccgattattattgtgcagcgtgggatgacaggaagaacggtta

SEQ ID NO: 444041 - DNA, 360 bp, Homo sapiens
  misc_feature: NA.25.37.D04.2.454.light.2.nb
  modified_base (139)..(139): a, c, t, g, unknown or other
  modified_base (198)..(198): a, c, t, g, unknown or other
gctcagttaggacccagagggaaccatggaagccccagctcagcttctcttcctcctgctactctggctcccagatagcaccggagaagttgtgttgacacagtctccagacaccctgtctttgtctccgaggggaaancgccaccctctcctgcagggccagtcagagtgttatcaggtacttagcctggtaccaanagaaacctggccaggctcccaggctcctcatctatgatgcatccaaaggcgggccacgtggcatcccagccaggttcagtcggcaggtggggctggggacagtgttcactctcaccatcagcagtctggacgctgaagtatttgctagtttattactgtcag

SEQ ID NO: 444042 - DNA, 428 bp, Homo sapiens
  misc_feature: NA.25.38.D05.2.454.light.2.nb
acaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaacaataaggacttctagcttggtatcagcagaaaccagggcagcctctaagctgctcatgtactgggctcgtacccgggatccccggtgtccctgaccgattcagtggcggcgggtctgggacagtatttcactctcaccatcagcagcctgcaggctagaagatgtggctagtttatactgtcagctaatattatactaactcggtcacgtttcggcggtcggaccaagtgaagagtacagacgaa

SEQ ID NO: 444043 - DNA, 396 bp, Homo sapiens
  misc_feature: NA.25.38.D05.3.454.light.2.nb
tcccgcccagtctgtgctgtctcagccaccctcagtgtctggggcccccgggcagagggtcgacatctcttgttctggaagtcgctccaacgtcggcagtaatagtgtaagctggtaccagcaactcccaggaaccggcccccacactcctcatgtatgggaatgatcagccgcccctgaggggtccctgaccgattctctgccctccacgtctggcacctcagccctccctggccatccgtggctccaatctgaggatgaggccgattattattgtgcagcgtgggatgacaggaagacggttatgtcttacggaattggggaccaaggtcaccgtctaggtcagcccaaggcccaacccactgtcactctcgttccccgccctcctcactgtac

SEQ ID NO: 444044 - DNA, 429 bp, Homo sapiens
  misc_feature: NA.25.39.D06.1.454.light.2.nb
ctgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggccaggcctcccaggctcctcatctatgatacttccagtacggccatggcatcccagcccgcttcagtggccaggtgggtctggggacagagtttcctcaccatctccagccctagagcctgaagtattttgctagtttatactgtcagctccgacaagaagtcggcctacaatatcactttcggcctagggaccaaagtgatatcaaaacgactgtgctgaa

SEQ ID NO: 444045 - DNA, 404 bp, Homo sapiens
  misc_feature: NA.25.39.D06.2.454.light.2.nb
agcaaaaactgacaagtcaaggcaggaagatgttgccatcacaactcattgggtttctgctgctctgggttccagcctccaggggtgaaattatgctgactcagtctccagtactttcagtctgtgactccaaaggcgaaagtcaccatcacctgccgggccagtcggagcattggtactaattacactggtaccagacaaaaaccaatcagtctaccaaagctcctcatcgagtctgccttcccagcccatgtcacggggtcccctgaggttcagtcggcagtggatcgtgggacgactttccaccctcaccatcagtgcctggaacctgaagatgctgacaacatattactgtacaacagagtagtgctccacctcactacttttggaccgaggggaccaaa

SEQ ID NO: 444046 - DNA, 306 bp, Homo sapiens
  misc_feature: NA.25.39.D06.5.454.light.2.nb
ggcttaggaagcagagcctggggcatctccaccatggcctggacccctctcctcctccagcttctcaccctctgctcagggtcctgggcacagtctgcgctgacccaggaagactcggtgtcggggaccgtgggacagaaagtcaccctgtcttgttctggtacgagcgacaacattggaacgtatcctggtgggctggtaccaacagaatggtcacggtccccccaaaatgtgatgtctggagatgttccgccctcgagggactccctgccccgcttctcgtggggtcacgtgtctgggaccaca

SEQ ID NO: 444047 - DNA, 398 bp, Homo sapiens
  misc_feature: NA.25.4.A04.3.454.light.2.nb
  modified_base (155)..(155): a, c, t, g, unknown or other
cagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagctaattattagcctggtatcaacagaaaccagggagagttccaagctcctgatctatgctgcctcacgttacacctcaggggtcccatctcggttcagcgcagtgaatcgtgggacagagttcactctcactatcagcagcctgcagcctgaagatgttgactaacttattactgtacaaaagtataataactcgccctcttctactttcggacggtacgggaccaag

SEQ ID NO: 444048 - DNA, 370 bp, Homo sapiens
  misc_feature: NA.25.46.E02.1.454.light.2.nb
  modified_base (162)..(162): a, c, t, g, unknown or other
tggtgttgcagacccaggtcttcatttctctgttgctctggatctctgttctgactacaggggccgacggggacatcgtgatgacccagtctccagactcgttggctgtgtctctgggcgagagggccaccgtcaactgcaagtccagccagagtcttttanacagtgccgacaataagaactacttagcttggtatcagcagaagccaggacagcctcctaagctgctcatttccggcatcgtacccgggaatccggggtcctgaccgattccagtggcagcggtctgggcagatttcactctcatcatcagcggctgcaacctgacgatgtgcgtttatactggtcagcaacactatcttactcctcg

SEQ ID NO: 444049 - DNA, 442 bp, Homo sapiens
  misc_feature: NA.25.53.E09.1.454.light.2.nb
  modified_base (306)..(306): a, c, t, g, unknown or other
tgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccgccagactgttgacaacgacttagcctggtaccaacagaagcctggccaggctcccaggctcctcatctatgatacttccagtaggccactggcatcccagcccgttcagtggccagtgggtctggggacagagtttacnctcaccatcctccagccctagacgcctgaagtattttgctagtttattactgtcagctccgacaagagtgcctcaatatcactttcgccctggaccaaagtgatatacaaacgactgtacgctgcacatctgtctc

SEQ ID NO: 444050 - DNA, 370 bp, Homo sapiens
  misc_feature: NA.25.56.F01.1.454.light.2.nb
  modified_base (138)..(138): a, c, t, g, unknown or other
  modified_base (163)..(163): a, c, t, g, unknown or other
gtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggngagtcaggacattaaccaattattagcctggtatcaacacaaaccaggaaagtccctaaagctacctgatctattctgcatccacttgccagtcaggggtcccatctcgcttcagcgcagtggatcgtgggacagtatttcagtctcaccatcaccggctgcagcctgacgatcttgcaacttattactagtacaaaactattacac

SEQ ID NO: 444051 - DNA, 363 bp, Homo sapiens
  misc_feature: NA.25.57.F02.3.454.light.2.nb
gagaagagctgctcagttaggacccagagggaaccatggaaaccccagcgcagcttctcttcctcctgctactctggctcccagataccaccggagaaattattttgacgcagtctccaggcaccctgtcttgtctccgaggggaaagccaccctctcctgcagggccagtcagagtgtgagcagcaacttcttagtctggtaccaacataaagcaggccaggcctcccagactcatcctgtacgggcaaccaccagggccaagggcactcccagacaggttcagtggcggtgggtctggggcagagttcactctcaccatcaacagactggagcctagaagtatttgctagtgtattattgt

SEQ ID NO: 444052 - DNA, 365 bp, Homo sapiens
  misc_feature: NA.25.6.A06.1.454.light.2.nb
gtagagaagacaggactcaggacaatctccagcatggcctggtcccctctcttcctcaccctcatcactcactgtgcagggtcctgggcccagtctgtgctgactcagccaccctcggtgtctgaagcccccaggcagagggtcaccatctcctgttctggaagcagctccaacgtcggagataatgctagtaaactggtaccagcaggtcccagggaacgcctccaaactcctcatctatatgatgatctgctcgcccctgaggggtctccgtgacccgtattcctctggctccaagtctggccacctcacgccctccctgccatcagtggctccagtctgagatgagctgtattattactgtg

SEQ ID NO: 444053 - DNA, 454 bp, Homo sapiens
  misc_feature: NA.25.64.F09.1.454.light.2.nb
taggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccgacgggccactggaacttccagccaggttcagtggcaggtgggtctggggacagtacttctctctcaccatcagcagcctgcagtctgacgtatttgctagtttattactgtcagcataagtaataaaacgtggtaccgtacgtaggtttacggaccgtaacgggggtacccaaaggccgttacgggaactacgttacgaacggtaacgtaaacgtt

SEQ ID NO: 444054 - DNA, 325 bp, Homo sapiens
  misc_feature: NA.25.66.F11.1.454.light.2.nb
gtccagccagagtcttttatacagtgccgacaataagaactacttagcttggtatcagcagaagccaggacagcctcctaagctgctcatttcctgggcatctacccgggaatccggggtccctgaccgattcagtggcagcgggtctgggacagatttcactctcatcatcagcggcctgcaacctgacgatgtggcggttatactgtcagcaacactatcttactccgtcggacgttcggaccaagggaccaaggtagaattcaagcgaactgtggcctgcaccatctgtcttcatccttcccgccatctgaactgtactagt

SEQ ID NO: 444055 - DNA, 354 bp, Homo sapiens
  misc_feature: NA.25.70.G04.1.454.light.2.nb
tctctcagtcaggacacagcatggacatgagggtccctgctcagctcctgggactcctgctgctctggctcccaggtaccagctgtgacatccagatgacccagtctccttccttcctgtctgcatctgtgggaacagagtcaccatcacttgccgggcagtcaggacattaccaattattagcctggtatcaacacaaaccaggaaagtccctaaagctcctgatctattctgcatccacttgcagtcacggggtcccatctcgcttcagcggcagtggatcgtgggacagatttcagtctcaccatcaccggctgcagcctgacgatcttgactaacttattacttacaaaa

SEQ ID NO: 444056 - DNA, 301 bp, Homo sapiens
  misc_feature: NA.25.71.G05.3.454.light.2.nb
agaacctatgaacattctgtaggggccactgtcttctcacggtgctcccaaaactgtgatgtttggaaattctccgccctcagggatccctgaccgcttctctggctcgaagtctgggaccacagcctccctgactatctcggacctccagcctgaggacgaggctgattattactgttctacatgggactacagcgtcagtggtcatgtggttttcggcggaggcaccaagctgaccgtcctaggtcagcccaaggctgccccctggtcactctgttcccgccctcctccactgtacagt

SEQ ID NO: 444057 - DNA, 364 bp, Homo sapiens
  misc_feature: NA.25.73.G07.1.454.light.2.nb
  modified_base (353)..(353): a, c, t, g, unknown or other
caggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggcagtcagagtatgccaattggttggcctggtatcagcagaaaccagggaaagcccctaaactcctagatttataagacctctagtttacaaagtggggtcccatcaaggttcagcggcagtggatctgggacaagaattcactctcaccatcagcagtctgcagcctgatgattctgactaacttattactgtacaaaagttnttatgtacttg

SEQ ID NO: 444058 - DNA, 379 bp, Homo sapiens
  misc_feature: NA.25.76.G10.3.454.light.2.nb
taggacccagagggaaccatggaggccccagctcagcttctcttcctcctgctactctggctcccagaaaccaccggcgaaattgtgttgacacagtctccagccaccctgtctttgtctccgaggggaaagccacgctctcctgcagggccagtcagagtatcggcaggtccttagcctggtatcgacagagccctggccaggcctcccaggcctcctcatctatgatgcatccaacgagggccactgaccgtcccagacaggttcagtggccagtgggtctgggacagacttcactctcaccatcagcagtctagagcctgaagtatttgctagtttatactgaccagcagcgtagcgactggcctcgtactagttt

SEQ ID NO: 444059 - DNA, 378 bp, Homo sapiens
  misc_feature: NA.25.82.H05.2.454.light.2.nb
ctcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctcatgcatagtaatggatacagctattggattggtacctgcagaggccagggcagtctccacagctcctgatctatttgcttctcagtccggggcccccgggtcctgacaggttcagtgcagtgatcgaggcacactattttcactgagcatcagcagagtggagctgaggatggttggggttatacgtgcatgcagcctcacaaactcc

SEQ ID NO: 444060 - DNA, 429 bp, Homo sapiens
  misc_feature: NA.25.86.H09.1.454.light.2.nb
gtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaactcctaagctcctgatctttgatgcctcagtttggaaagtggagtccatcaaggttcagcggcagtggatcgtgggacagatttcatcctcaccatcagcagcctgcagcctgaagattctgactaaccttattattgtacaaactaatttaaggatttaccctctcttccgttcgggcggagggaccaaggtggagactacaaacgactgt

SEQ ID NO: 444061 - DNA, 204 bp, Homo sapiens
  misc_feature: NA.25.86.H09.4.454.light.2.nb
ataccagatgtgacgtccagatgacccagtctccatcctccctgtctgcatctgttggagacagaatcagcatcacttgccgggcagtcagggcattagcaattatttagcctggtatcaaacagaaaccagggagagttcctaagctcctgatctatgctgcctccacgttacactccgaggggtcccatctcggttcagcgg

SEQ ID NO: 444062 - DNA, 401 bp, Homo sapiens
  misc_feature: NA.2.1.A01.1.454.light.2.nb
aggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacatgttaataattggtgctggtatcagcagaaaccagggaaagcccctaaactcctgatctctgatgcctccaatttggaaagtgggtcccatcaaggttcacccggcagtggatctgggacacagttcactctcaccatcagcagcctgcagcccgatgactttgcatcttatactgaccaatagtataattagtttctcggtcaggtttcggacggagggtacgaaaggtggagatacgaaa

SEQ ID NO: 444063 - DNA, 349 bp, Homo sapiens
  misc_feature: NA.2.10.A10.1.454.light.2.nb
gggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttatacagctaccaaacaaaagactacttaggtgtaccagcaagaaaccaggcagcctactaagctgctcattacctggcatcctacccgggaatcgtcggggtccctgaccgattccagtggcaggcgggtctgggcagtatttcactctcaccatcaccaacctgcaggctagaagatgtggtccgttta

SEQ ID NO: 444064 - DNA, 418 bp, Homo sapiens
  misc_feature: NA.2.25.C03.1.454.light.2.nb
  modified_base (136)..(136): a, c, t, g, unknown or other
tcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggacgtatgtagcctggtaccagcagaaacctggccaggctcccagactcctcatctctggggcatccagcagggcccccggcactcccagacaggttcagtggcagtgggtctgggacagaagttcaactctcacaatcagcagactggagcctagaagtattttgcagtgtatttctgtacaacaaatatcgtacgtacccccttagtcggtaccgtttcggccgtagggggtaccctaaaggg

SEQ ID NO: 444065 - DNA, 429 bp, Homo sapiens
  misc_feature: NA.2.34.D01.1.454.light.2.nb
aggcagcgctctcaggacgtcaccaccatggcctgggctctgctcctcctcaccctcctcactcagggcacagggtcctgggcccagtctgccctgactcagcccccctcgcgtccgggtctcctggacagtcagtcaccatctcctgcactggaatcagcagtgacctgagtccttataactatgtctcctggtaccaacaacacccaggacaaacgccccaaatcattattatgaagtcactaagcggccctcgaggggtccctgatcgctttctctggctccaagtctggcgagacggcctccctgaccgtctctgggctccaggctgaagtgaggctgattattactgcagctcatatgcaggcagcaaacaatgtggcagttcggcggagggaccaagctgaccgtctgggtcagcccaaggct

SEQ ID NO: 444066 - DNA, 451 bp, Homo sapiens
  misc_feature: NA.2.49.E05.1.454.light.2.nb
agctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggagagggtcaccatctcttgttctggaagcatgtccaacatcggaagtgataatgtatactggtaccagcagttcccaagacgccggcccccaagcctcctcatctatagaaattatgaaccggtcctcgacggggtccctgacccgattctctggctccaagtctggcacctcacgccctccctggcccatcaggtcgggctccggtccgaggatggaggctgattattactgtgttggatgggacagcagcctgagtgcttatgtcttcggaacgtgggaccacggtcaccgtcct

SEQ ID NO: 444067 - DNA, 421 bp, Homo sapiens
  misc_feature: NA.2.7.A07.1.454.light.2.nb
  modified_base (298)..(298): a, c, t, g, unknown or other
taggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccacagggccactggtatcccagccaggttcagtggcaggtgggtctggggacaggagttcattcncaccatcagcagcctgcagtctgaagtatttgactaatttattactgtcagcagtataataacgtggtgacgttcggaccaaagggaccaaaggtagaaaatacaaaacgtaactgtaggctg

SEQ ID NO: 444068 - DNA, 394 bp, Homo sapiens
  misc_feature: NA.2.76.G10.2.454.light.2.nb
gtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcgaggggtccctgaccgattctctgcctccaagtctggcacgtcagccttcctggacatccgtggcctccagtctgcggatgaggtcttgtttatttctgttcagcacgggatcgccagcggaatggacaagttggggtattcgggcggagggaccaagttcgaccgtctaagtcagcccaaggctcgccccctggtcactctcgttccccaccctcctctgtcgagcgt

SEQ ID NO: 444069 - DNA, 382 bp, Homo sapiens
  misc_feature: NA.2.83.H06.1.454.light.2.nb
ccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggcagtttattactgtcagcctagttctttcttcctcctcggacttttggccaagggaccaagctggagatcaaacgaactgtggctgcaccatctgtcttcatcttcccgcctatctgatgtcgagcgt

SEQ ID NO: 444070 - DNA, 422 bp, Homo sapiens
  misc_feature: NA.38.1.A01.1.454.light.2.nb
taggacccagacggaaccatggaagccccagcgcagcttctcttcctcctgatactctggctcccagaaatcactggagaaatcgtgatgacgcagtctccagccaccctgtctgtgtctccaggggagagagccaccctctcctgcagggccagtcagagtgttagaacaacctagcctggtaccatcagaacctggccaggctcccagactcctcatctatgatgcatcccaccagggccactggtcgtcccagccaggttcagtggcagtgggtctgggacaggagttcactctcaccatcagcagcctgcagtctagaagtatttgctagtttattattgtcagcagtatgatcagtgcctcgatcaccttcggccgacggggacacgactacggacaagtaaacgaacgtgtaggct

SEQ ID NO: 444071 - DNA, 414 bp, Homo sapiens
  misc_feature: NA.38.11.A11.1.454.light.2.nb
acagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacgaccgttgggttggcctggtatcagacaagaaaccagggaaagcccctatgtccctaatctttgatgcatccactttgcaaactggggtcccatctaggttcagcgcccagtggatctggacagtaattcactctcaccatcgacaacctgaacgcctagaagattctgctaatttattactgaccaaacaatataatacttacccggtacaccttcgaccaagggacacgactggagattaaacgaactgt

SEQ ID NO: 444072 - DNA, 400 bp, Homo sapiens
  misc_feature: NA.38.12.B01.1.454.light.2.nb
gttaggacccagagggaaccatggaaaccccagcgcagcttctcttcctcctgctactctggctcccagataccaccggagacattttatgacgcagtctccaggcaccctgtctttgtctccaggggaagagccaccctctcgtgcagggccagtcagagtgttagtagcaggcacttagcctggtatcagcagaacctggccaggctcccaggctcctcatctatggtgttctagcagggccattggcatcccagacagattcagtggcaggtgggtctgggacgacttcactctcaccatcaacagactggagcctagaagtattttgcggttctatttctgtcagcagtatgataccgttgtggacgttcggccaaaggggaccaaagggtggaaa

SEQ ID NO: 444073 - DNA, 337 bp, Homo sapiens
  misc_feature: NA.38.13.B02.1.454.light.2.nb
aggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctactggtaccaacaacacccaggacaaacgacccccaaatcatgtatttatgagtcactaatcgccctgagggtttctaatcgcttcctctgctccaagtctggcaacacggcctccctgaccatctctggctccgagctgaggacgag

SEQ ID NO: 444074 - DNA, 322 bp, Homo sapiens
  misc_feature: NA.38.18.B07.1.454.light.2.nb
aggacccagacggaaccatggaagccccagcgcagcttctcttcctcctgctactctggctcccagtttcacaaaccactggagaagtagtgatgacgcagtctccagccaccctgtctgtgtctccaggggacagccgccaccctctcctgcagggccagtcacagtataacaataacttagcctaggtaccaacagcagactggccaggctcccaggctcatcatgtatggttcatccacgagggcctacgtggtcgtcccaggcaggttcaggacggaaggcgggtctggggacaggagttcactctacacctattaac

SEQ ID NO: 444075 - DNA, 439 bp, Homo sapiens
  misc_feature: NA.38.20.B09.1.454.light.2.nb
  modified_base (174)..(174): a, c, t, g, unknown or other
ggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttactgggccctcgtacccgggatccggggtcctgaacgtattcagtggcggcggtctgggcagatttcactctcaccatcagcagcctgcggctgaagagtgtggtcgtttattactgtcagcagtattatgttactctcactagtttggccgtaggggaccaagctggagatcgcacgaacgtgtggctgcacc

SEQ ID NO: 444076 - DNA, 405 bp, Homo sapiens
  misc_feature: NA.38.22.B11.1.454.light.2.nb
taggacccagacggaaccatggaagccccagcgcagcttctcttcctcctgctactctggctcccagataccactggagaaatagtgatgacgcagtctccagccaccctgtctgtgtctccgaggggaaagccaccctctcctgcagggccagtcagagtgttagcagcaacttagcctggtaccagcagaacctggccaggctcccaggcctcctcatctatggtgcatcccaccgagggccacgtggtactcccagccagggtcaggtggcaggtgggtctggggacaggagttcactctcaccatcagcagcctgcagtctgaagtatttgctagtttattctgtcagctattacaattactggtccctctacgtggacgttcggccgaggggaccaaggg

SEQ ID NO: 444077 - DNA, 409 bp, Homo sapiens
  misc_feature: NA.38.23.C01.2.454.light.2.nb
acaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgtagcttggtaccagcagaaagcacgacagtcccctaagttgctcatttatggtcatctactcgggtgtccggggtcctgaccgattcagcgcagcggatctgggacagatttcactctcaccatcagcagcctgcagactgaagatgtggctagtttatactgtcagcaatatatggtagtcctcggctcactttcggcgaggaccaaggtgaga

SEQ ID NO: 444078 - DNA, 408 bp, Homo sapiens
  misc_feature: NA.38.25.C03.3.454.light.2.nb
acaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgctggtaccagcaagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctaagtactttgggccggggttacaa

SEQ ID NO: 444079 - DNA, 355 bp, Homo sapiens
  misc_feature: NA.38.27.C05.2.454.light.2.nb
  modified_base (138)..(138): a, c, t, g, unknown or other
ctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaacctgccaggctcccaggctcctcatttatggtgcgtccaccaggccacgtggcatcccagacagattcagtggcagtgcgtcgtgggcagacttcactctcgtgatcgacagactggacccaaacagtatttgcttgtagtattactgt

SEQ ID NO: 444080 - DNA, 423 bp, Homo sapiens
  misc_feature: NA.38.28.C06.5.454.light.2.nb
tggagaagagctgctcagttaggacccagagggaaccatggaaaccccagcgcagcttctcttcctcctgctactctggctcccagattccaccggagagattgtgttgacgcagtctccaggcaccctgtctttgtctccgagggaaagagccaccctctcctgcagggccagtcagagttgtttcaacggtctacttagcctggtaccagacaaaacctggccaggctcccaggctcctcatctatggtacatccgtcacgggccacgtggtactcccagacaggttcagtggcagtgggtctgggacagacttcactctcaccatcagcagactggagctagaagtatttgctagtgtattactgtcagcagtatactacaagtaccgtactactttggcctagggggaccaagcgtgga

SEQ ID NO: 444081 - DNA, 354 bp, Homo sapiens
  misc_feature: NA.38.3.A03.1.454.light.2.nb
acatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctctgtaccaacatcaccagacaagccccaaatcataatttagacgtcagtagtcggccctcgaggggtttctgatcgcttctcaggcctccaagtctggcaaacacggcctcctgaccatctctgggctccaggttgaggacgaggctgactattattgcgctcacagtggaatcgagggt

SEQ ID NO: 444082 - DNA, 322 bp, Homo sapiens
  misc_feature: NA.38.33.C11.1.454.light.2.nb
  modified_base (232)..(232): a, c, t, g, unknown or other
  modified_base (236)..(236): a, c, t, g, unknown or other
tgctcagttaggacccagacggaaccatggaagccccagcgcagcttctcttcctcctgctactctggctcccagataccactggagaaatagttatgacgcagtctccagccaccctgtctgtgtctccgaaggggaaagccaccctctcctgcagggccagtcagagtgttagcgacaacttagcctggtaccagcagaaacctggccaggctccaggctctcatttagnggtncatccacgaggccacgtggtctcccagccaggttcagtggccaggtgggtctggggacagagttcactctacacatcagcagcctg

SEQ ID NO: 444083 - DNA, 437 bp, Homo sapiens
  misc_feature: NA.38.36.D03.1.454.light.2.nb
ctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaacgcccccaaactcattatttatgagtccgaatcggcctcaggatttctaatcgcttctctggctccaagtctggcaacacgcctccctgaccatctctggactccaggctgaggacgaggggctgattactactgcagttcatatacaagcaactacttcctcttctgttattcggcggagggaaccagggtcgaccgtcctaagtcacgacccg

SEQ ID NO: 444084 - DNA, 293 bp, Homo sapiens
  misc_feature: NA.38.36.D03.2.454.light.2.nb
tcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataattgtctctggtaccaacagcacccggcaatcgacccccaaaatcaatgtatttatgaggtcactcatccggccctcgtacggggtttctaatcgtcttctctgcact

SEQ ID NO: 444085 - DNA, 479 bp, Homo sapiens
  misc_feature: NA.38.38.D05.1.454.light.2.nb
caggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttatgctcctcatatacaggcagcagcaccccttatgtcttcggaactgggaccaaggtcaccgtcctacgtcacgcccaaggccaaccccactgtcactctcgttcccaccctcctcacgtgatcga

SEQ ID NO: 444086 - DNA, 403 bp, Homo sapiens
  misc_feature: NA.38.39.D06.1.454.light.2.nb
ctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgaccgtgaccgtctaggtcagcccaag

SEQ ID NO: 444087 - DNA, 379 bp, Homo sapiens
  misc_feature: NA.38.4.A04.2.454.light.2.nb
caggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagacaaaaaccagggaaacgcccctaaactcctgatctatggtgcatccattttgactaaaggtggggtacccatcaaggttcagcggccaggtggatcgtgggaacagattcagtctcacaatcagcagcctgcagcctaggagatactgactaacttattattgtctaacagtacttaataccgttacccc

SEQ ID NO: 444088 - DNA, 426 bp, Homo sapiens
  misc_feature: NA.38.5.A05.2.454.light.2.nb
gcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcaccggcaatcgacccccaaaatcatgatttatgagtcactcatcggcctcgaggggtttctaatcgcttctctgcatccaagtctggcaacacggcctccctgaccatctctgggctccaggctgaggacgaggctaattatttctgctagttcatatacaacagcaacactctgctattcggcggagggaccaagcttgccgtcaagtcagcccaggctcgccc

SEQ ID NO: 444089 - DNA, 336 bp, Homo sapiens
  misc_feature: NA.38.55.E11.2.454.light.2.nb
  modified_base (211)..(211): a, c, t, g, unknown or other
  modified_base (324)..(324): a, c, t, g, unknown or other
catcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagattaattttgtctcctggtaccagcagctcccaggaacagcccccaaatcctcatttangaccataataggcgaccctcaggattcctgaccgattctctggctccaagtctggcaccgtcagccaccctggcatcaccggcctccagactggggacaggccgattatacgngacgaacagtgg

SEQ ID NO: 444090 - DNA, 372 bp, Homo sapiens
  misc_feature: NA.38.6.A06.1.454.light.2.nb
  modified_base (183)..(183): a, c, t, g, unknown or other
gtcaactggatggcacatctggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaacgaggaaacncccctaagctcctgatctatgctgcctccactttgcaaagtggggtcccatcaaggttcagcggcagtggatccgtgggacagtatttcactctcacatcagcagcctgcagccctagaagtattttgactaactttattactgtacaaactagtactttaaatagtttaatccttactaacgtttcgg

SEQ ID NO: 444091 - DNA, 437 bp, Homo sapiens
  misc_feature: NA.38.7.A07.1.454.light.2.nb
  modified_base (282)..(282): a, c, t, g, unknown or other
gtcagcaccatggcttggaccccactcctcttcctcaccctcctcctccactgcacagggtctctctcccagcttgtgctgactcaatcgccctctgcctctgcctccctgggagcctcggtcacgctcacctgcactctgagcagtgggcacagcagcaacgccatcgcatggcatcaacatcagccagagaagggccctggtacttgatgaagcttaaatagtgatggcaccctcaaccgaaggggagacgggatcccctgactcgcttctcaggctccngctcgtggggctgagcgctacctcaccatctccagcctccagtctgagatgaggctgactattactgtcagacgtggggcacgtgtccggtttgggtattcgggcggacgggaccaagcgtgaccgtctaaggtcaacgcccaaggcctcgcccc

SEQ ID NO: 444092 - DNA, 363 bp, Homo sapiens
  misc_feature: NA.39.11.A11.2.454.light.2.nb
agcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctctggtaccaacaacaccccggcaaacgcccccgaagtcatgatttatgacgtcactaatcggccctcgaggggttctaatcgcttcctctggctccaagtctggcaacacggcctccctgaccatctctggctcaggctgaggacgaggctgattatactgcagctcatattcaagca

SEQ ID NO: 444093 - DNA, 461 bp, Homo sapiens
  misc_feature: NA.39.13.B02.1.454.light.2.nb
gaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaacgtccccaaatgatgatttatgaggtcactaaacggccctcgtagggtttctaatcgcttcctctggctccaagtctggcaacacggcctccctgaccatctctgggctccaggctgaggacgaggctctctattattgcagctcatatacaagcattatctacgtttggggtgttcgggcgggagggacccgaaccgtcggaccgttcgttaggtcaagcccaaggctcgcccctcggtctacc

SEQ ID NO: 444094 - DNA, 181 bp, Homo sapiens
  misc_feature: NA.39.16.B05.2.454.light.2.nb
tcagacccagtcaggacacagcgtggacatgagggtccccgctcagctcctggggctcctgctgctctggttcccaggttccagatgcgacatccagatgacccagtctccatcttccgtgtctgcatctgtaggagacagagtcacatcacgttgtcgggcgagtcgagggtattagcag

SEQ ID NO: 444095 - DNA, 412 bp, Homo sapiens
  misc_feature: NA.39.17.B06.1.454.light.2.nb
gcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaacaataaaaactacttagcttggcaccagcagaaaccaggacagcctcctagagtgctcatttactgggcatctaccgggaatccggggtccctgaccgattcagtggcagcggatctgggaccagatttcactctcaccatcagcagcctgcagctgaagatgtggctagttatactgtcacaatattataatactctcagtactttgcctaggggaccaagctaggagatacaaacgaactgtaggctgcacatctgt

SEQ ID NO: 444096 - DNA, 313 bp, Homo sapiens
  misc_feature: NA.39.18.B07.1.454.light.2.nb
  modified_base (263)..(263): a, c, t, g, unknown or other
agtcaggacacagcatggacatgagggtccctgctcagctcctgggactcctgctgctctggctcccagatgccagatgtgacatccagatggcccagtctccatcctccctgtctgcatctgttgggacagagtcaccatcacttgccgggcgagtcaggacattagctagttattagcctggtatcaacacaagccagggcaagttcctaagctcctgatctattctgcatccactttacaatcagggtccatctcgttcngtgcagtgatcgtggacagacttcgctctcacatcagccacctgcagcct

SEQ ID NO: 444097 - DNA, 401 bp, Homo sapiens
  misc_feature: NA.39.20.B09.1.454.light.2.nb
attctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggccctcgagggactcccgtgagcgattctctggcctccaactctcgggaacacagcccactctacgaccatcacgccgggacccaggcctaagtggatgaagctagactattatgtcaggtgtgggacagcagcgaaaggg

SEQ ID NO: 444098 - DNA, 441 bp, Homo sapiens
  misc_feature: NA.39.28.C06.1.454.light.2.nb
tcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaagctcctgatctatgctgcatccagtttgcaaagtggggtccccatcaaggttcatcggcagtggatcgtgggacagatttcactctcaccatcagcagcctgcagcctagaagtattttgactaaacttacttattcgtacaaacaggacttaaacgtacggttttaccccgaagggtaaccgtttccgggaccgtaaacggggaacccgttaaaggggt

SEQ ID NO: 444099 - DNA, 413 bp, Homo sapiens
  misc_feature: NA.39.29.C07.1.454.light.2.nb
  modified_base (172)..(172): a, c, t, g, unknown or other
  modified_base (184)..(184): a, c, t, g, unknown or other
acaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaaanaataacaactacttaactggatcagcaagaaattaggccagcctacctaagcgactcatttcctgggcatctacccgggaatccggggtcctgaccgattcagtggcagcgggtctggggacagtattcactctcaccatcagcagcctcgaggctagaagatgtgctagtttatactgtcagcagatattgatattccgtggacgttcggccaagggaccaaaggtcg

SEQ ID NO: 444100 - DNA, 410 bp, Homo sapiens
  misc_feature: NA.39.31.C09.1.454.light.2.nb
gatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactgggcatctacccgggagtccggggtccctgaccgattcagcggcagcgggtcctgagacagatttcactctcaccatcagcagcctgcaggctgaagatgtggctagtttatactgtcagcagttattatagtagtcctcagtacgtttggccggggtacaagcgtaggagatacaaacgac

SEQ ID NO: 444101 - DNA, 361 bp, Homo sapiens
  misc_feature: NA.39.34.D01.2.454.light.2.nb
  modified_base (135)..(135): a, c, t, g, unknown or other
cagttaggacccagagggaaccatggaaaccccagcgcagcttctcttcctcctgctactctggctcccagatacgaccggagaaattgtgttgacgcagagtccaggcaccctgtctttgtctccaggggaaanagccaccctctcctgcagggccagtcagaaattagagcacctacttagcctggtaccagacaaaacctggccaggctcccaggctcctcatttatggtgcgtccagcagggccacgtggcatcccagacaggttcagtgcagtggtctgggacagacttcactctcacgatcgacagactcggacccaacagtatttgcttgtgtattactgtacaacactacgga

SEQ ID NO: 444102 - DNA, 159 bp, Homo sapiens
  misc_feature: NA.39.37.D04.2.454.light.2.nb
actctcaccatcagcagactggagcctgaagattttgcagtctatcactgtcagcagtatggtgactcaaagacgttcggccaagggaccaaggtggaaatcaaacgaactgtggctgcaccatctgtcttcatcttcccgccatctgaactagtgcga

SEQ ID NO: 444103 - DNA, 345 bp, Homo sapiens
  misc_feature: NA.39.38.D05.1.454.light.2.nb
ctcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtcttaatagctggttggcctggtatcagcagaaaccagggaaagcccctaagctcctggtctctggtgcctccagtttgcaaagtggggtcccatcaaggttcagcggcagtgaatctgggacagattcactctcaccatcacagcctgcgcctgaagtatttgctaacttattactgt

SEQ ID NO: 444104 - DNA, 442 bp, Homo sapiens
  misc_feature: NA.39.39.D06.1.454.light.2.nb
ctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataatatgtctcctggttccaacagcattcaggcagccgccccgaaactcttaatttatgaggttctttcgtcggccctcgtacggggtttctagtcgcttctccggctccaagtctggcaacacggcctccctgaccatctctagactccaggctgaggacgaggctgactattattgcagctcatatactgaagtcaatggtatccactggctgttcggcggaggaaccaagttcgaccgtcttaggtcagacccg

SEQ ID NO: 444105 - DNA, 405 bp, Homo sapiens
  misc_feature: NA.39.50.E06.1.454.light.2.nb
  modified_base (140)..(140): a, c, t, g, unknown or other
ctgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctcctgcagggccagtcagactattagcagcaacttagcctggtaccagacaaaacctggccagactcccaggctcctcatgtatggtgcgtccaccgagggccacgtggtactcccagccaggttccagtggcaggtgggtctgggcagagttcagtctcaccatcagcagcctgcagtctgaagtatttgtactttattactgtcagcagtatgatacctggcctcacactttggcctaggggccaggttggag

SEQ ID NO: 444106 - DNA, 309 bp, Homo sapiens
  misc_feature: NA.39.52.E08.1.454.light.2.nb
  modified_base (285)..(285): a, c, t, g, unknown or other
tcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttggtcgggcgagtcaggtattattagtatttattagcctgattcaacacaaagcgaggggacgaccccaaatccctagattcatgctgtcttccaatttgacaaagtggacgtcccgtacaaagttcagtcggcaagtggntcgtggcacactatttcactctac

SEQ ID NO: 444107 - DNA, 161 bp, Homo sapiens
  misc_feature: NA.39.53.E09.3.454.light.2.nb
actctcaccatcagcagcctgctgcctgaagatgctgcaacttattactgtcaaaagtatgacagtgtcccgtggacgttcggcccagggaccaaggtggaaatcaaacgaactgtggctgcaccatctgtcttcatcttccgccatctgaactagtgcga

SEQ ID NO: 444108 - DNA, 209 bp, Homo sapiens
  misc_feature: NA.39.54.E10.1.454.light.2.nb
atccctgagcgcttctcaggctccagctctggggctgagcgccacctcaccatctccagcctccagtctgaggatgaggctgactattactgtcagacctggggcactggcattcatgtggtattcggcggagggaccaagctgaccgtctgggtcagcccaaggctcgcccctggtcactctcgttcccgccctcctcactagtgcga

SEQ ID NO: 444109 - DNA, 369 bp, Homo sapiens
  misc_feature: NA.39.56.F01.1.454.light.2.nb
gagctgctcagttaggacccagagggaaccatggaaaccccagcgcagcttctcttcctcctgctactctggctcccagataccaccggagaaattgtgttgacgcagtctccagccaccctgtctttgtctccgaggggaaagccaccctctcctgcagggccagtcagagtgtagcagcacctacttagcctggtaccagcagaacctggccaggctccaggcctcctcatctatggtgcatccaccgagggccacgtggcactccccgaacggttcagtggcaggtgggtctggggacagacttcactctcaccatcagcagactggagcctagaagtatttgctagtgtattactgtcagcagta

SEQ ID NO: 444110 - DNA, 323 bp, Homo sapiens
  misc_feature: NA.39.6.A06.1.454.light.2.nb
catccagatgacccagtctccttccaccctgtctgcatctgtaggagacagagtcaccatcacttgccgggccagtcagagtattagtagctggttggcctggtatcagcagaaaccagggaaagtcccaaacctcctaatttataaggcgtcgactttagaaagtggggtcccatcaaggttcagcggcagtggatctgggacagaattcagtctcaccatcagcagcctgcagcctgaagtattttgcaactttattactgaccaacagtataactttactttacccgtactacttttggaccaggggaccaaagctagga

SEQ ID NO: 444111 - DNA, 416 bp, Homo sapiens
  misc_feature: NA.39.71.G05.1.454.light.2.nb
tgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactcggtactcccagcctacctttagtgcagtgggtctggggacagagttcactctcaccatcagcagcctgcagtctgaagtatttgctagtttattactgtacaacagtacaatgactggcctctctacgtttcggcggtagggaccaaggtggagatacaaa

SEQ ID NO: 444112 - DNA, 165 bp, Homo sapiens
  misc_feature: NA.39.71.G05.3.454.light.2.nb
gctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcga

SEQ ID NO: 444113 - DNA, 425 bp, Homo sapiens
  misc_feature: NA.39.8.A08.1.454.light.2.nb
  modified_base (287)..(287): a, c, t, g, unknown or other
taggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccgagggccactggtactcccagccacctttagtggcagtgggtctgggacngagttcactctcaccatcagcagcctgcagtctgaagtatttgctagtttattactgtacaacagtacaatgactggcctctctacgtttcggcggagggaccaaggtggagatcaaacgactgtggctgcaccatct

SEQ ID NO: 444114 - DNA, 288 bp, Homo sapiens
  misc_feature: NA.39.80.H03.1.454.light.2.nb
  modified_base (162)..(162): a, c, t, g, unknown or other
  modified_base (236)..(236): a, c, t, g, unknown or other
ggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccngcagtgacattggtagtgataactatgtctcctggtaccaacaatacccaggaacgccccaaatcatcatttangagtcaataatcggccctcgaggtatttctgatcgcttctctgctccaagtc

SEQ ID NO: 444115 - DNA, 423 bp, Homo sapiens
  misc_feature: NA.39.81.H04.6.454.light.2.nb
tcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctaccaaggcgaccttaatttataaggtttctaaccgggactcgtggggtcccagacagattcagcggcagtgggtcaggcactgaattcacactagaaaatcagcgagggtggaggctgaggtagttggttgggtttattacgtgcatgacaaaggaacacactggcctccgtacactttggccaggggaccaagctgga

SEQ ID NO: 444116 - DNA, 478 bp, Homo sapiens
  misc_feature: NA.39.86.H09.1.454.light.2.nb
caggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttatgagtcagtaatcggccctcgaggggtttctaatcgcttctctggctccaagtctggcaacacggcctccctgaccatctctgggctccgaggctgaggacgaggctgattatactgcagctcatttgacaatcagtgaggcttatgtcttcggaagtgggaccaaggtcatcgtcctaggtcagcccaaggaccaacccactcgtcactctcgttcccaccctcctcactagtgcga

SEQ ID NO: 444117 - DNA, 361 bp, Homo sapiens
  misc_feature: NA.39.86.H09.2.454.light.2.nb
aggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagttctttcgtcggccctcgtaggggtttcacgtcgcttctccggctccaagtctggcaacaccggcctccctgaccatctctagactccagctgaggacgaggctgactattattgcag

SEQ ID NO: 444118 - DNA, 414 bp, Homo sapiens
  misc_feature: NA.39.87.H10.2.454.light.2.nb
cagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagctggtatcagcaagaaaccaggaaaactcctaaggtcctgatctatgatgcctcagtttggaaagtggggtaccagtcaaggttcagcgcagtggatcgtgggacagtatttcactctcacatcacagcctgcgcctgaagtatttgactaacttattactgtacaactaatttaattcttaatccgtactctacgtttcgggacggtaaggggaaccctaaaggggt

SEQ ID NO: 444119 - DNA, 318 bp, Homo sapiens
  misc_feature: NA.3.1.A01.1.454.light.2.nb
acatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtccttccccctggccgccctgcctccaggacgcacctccgagacgcacagccggccctggggctgcccctggtcaaggctacttccgagtgcgtct

SEQ ID NO: 444120 - DNA, 217 bp, Homo sapiens
  misc_feature: NA.3.1.A01.2.454.light.2.nb
actgctcagttaggacccagagggaaccatggaagccccagctcagcttctcttcctcctgctactctggctcccagataccaccggagaaattgtgttgacacagtctccagccaccctgtctttgtctccaggggaaagccacctctcctgcagggccagtcagagtgttagcaactacttagcctggtaaccaacagaaacctggccaggctcc

SEQ ID NO: 444121 - DNA, 414 bp, Homo sapiens
  misc_feature: NA.3.10.A10.1.454.light.2.nb
ggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctgagggatcccgtgagcgattctctggctccagctcgagggacaacagtcacgttgaccatcagtgagtccaggcagaggacgaggctgactattatgtacaatcagcagacaacagtaatacttatctttaatgtcttcggatctgggaccagggtcaaccgtctaggtca

SEQ ID NO: 444122 - DNA, 293 bp, Homo sapiens
  misc_feature: NA.3.11.A11.1.454.light.2.nb
  modified_base (278)..(278): a, c, t, g, unknown or other
agcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgactgtggctgcaccatcctgtcttcatcttcccgcntctgagagtgcgtct

SEQ ID NO: 444123 - DNA, 426 bp, Homo sapiens
  misc_feature: NA.3.12.B01.1.454.light.2.nb
tcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctcctcatctatgatgcatcccacgagggcccaccggtatccccagccaggttcagtggcaggtgggtctggggacaggagttcactctcaccatcagcagcctgcagtctgaggtatttgctagtttattactgtcagctattacaataactggcctcggctcacgtttcggcggacgggtaccgaagggtggaagaactacgaaa

SEQ ID NO: 444124 - DNA, 232 bp, Homo sapiens
  misc_feature: NA.3.14.B03.1.454.light.2.nb
catggcctggaccgttctcctcctcggcctcctctctcactgcacaggctctgtgacctcctatgtgctgactcagccaccctcggtgtcagtggccccaggaaagacggccaggattacctggtggggaaacaaattggagaataaaagtgtgcactggtaccagcagaagccaggccaggcccctgtgctggtcatccattctgatagcgacccgcccctcagggatccc

SEQ ID NO: 444125 - DNA, 379 bp, Homo sapiens
  misc_feature: NA.3.20.B09.2.454.light.2.nb
  modified_base (271)..(271): a, c, t, g, unknown or other
agtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaatggtatcagcacaaaccgaggaaacccctaagctcctgatctatgctgaatccactttgcaaagtgggtccccatcaaggttcagtggcngtgatcgtgggacagatttcactctaaccatcagcgtctgcaacctgaagtattttgctaactcactactgtacaaacagagtgacagcacgcctcacactttcggac

SEQ ID NO: 444126 - DNA, 351 bp, Homo sapiens
  misc_feature: NA.3.25.C03.1.454.light.2.nb
  modified_base (175)..(175): a, c, t, g, unknown or other
aggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttatgaggtcacaaagcggccctcaggggtccctgatcgcttctctgcctccaagtctggcaacacggcctccctgaccgtctctggctccagcctgaggatgaggctgattatactg

SEQ ID NO: 444127 - DNA, 386 bp, Homo sapiens
  misc_feature: NA.3.31.C09.1.454.light.2.nb
ctgctcagttaggacccagagggaaccatggaagccccagctcagcttctcttcctcctgctactctggctcccagataccaccggagaaattgtgttgacacagtctccagccaccctgtctttgtctccaggggaaaagccaccctctcctgcagggccagtcagagtgttagcaactacttagcctggtaccaacagaaacctggccaggctcccaggctcctcatctatgatgcatccaacagggccactggcatcccagccaggttcagtggcagtggtctgggacagcttcactctcaccatcagcagcctagagcctagaagtattttgctagtttattactgtcagcagcgtagcaactggcctctctacgtttcggg

SEQ ID NO: 444128 - DNA, 471 bp, Homo sapiens
  misc_feature: NA.3.33.C11.1.454.light.2.nb
caggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtattataactatgtctcctggtaccagcagcacccaggcaaacgcccccaaatcatgatttatgaggtcaacaaagcggccctcaggggtccctgatcgcttctctgcctccaagtctggcaacacggcctccctgaccgtctctgggctccagcctgaggatgaggctgattattactgcagctcatatgcaggcatcaacactgtttcggcggagggaccaagctgaccgtcctaggtcagcccaaggctgcccccggtcactctcgttcccgccctcctcgacgtgcgtct

SEQ ID NO: 444129 - DNA, 220 bp, Homo sapiens
  misc_feature: NA.3.33.C11.2.454.light.2.nb
agcggccctcagggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagcccaaggctgccccctcggtcactctgttccccgccctcctcgagtgcgtct

SEQ ID NO: 444130 - DNA, 183 bp, Homo sapiens
  misc_feature: NA.3.33.C11.3.454.light.2.nb
tcaggaggcagcgctctcaggacgtcaccaccatggcctgggctctgctcctcctcaccctcctcactcagggcacagggtcctgggcccagtctgccctgactcagcctcctccgtgtctgggtctcctggacagtcggtcaccatctcctgcactggatccaccggtgacgttgctactta

SEQ ID NO: 444131 - DNA, 434 bp, Homo sapiens
  misc_feature: NA.3.36.D03.1.454.light.2.nb
  modified_base (270)..(270): a, c, t, g, unknown or other
tgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggcccactggcatcccgganaggttccagaggcagtgggtatgggcagacttcactctcaccatcagcagactggagcctggagtatttgacagtttattactgtcagcagtatggtacttacaaacttcggaccaggggacacgactggagattaagcgaactgtggctgcaccatctgtctt

SEQ ID NO: 444132 - DNA, 406 bp, Homo sapiens
  misc_feature: NA.3.37.D04.1.454.light.2.nb
aggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtaatataattatgtctcctggtaccaacaactcccaggcaaacgcccccaaactgatgatttatgatgtacaataatcggccctcgtaggggtttactaatcgtcttcctctggctccaagtctggcaacacggcctccctgaccatctctgggctccgagggtgaggacgaggctgattatactgcagctcatttacaagcagcacactcagtcttcggaactgggact

SEQ ID NO: 444133 - DNA, 409 bp, Homo sapiens
  misc_feature: NA.3.38.D05.2.454.light.2.nb
tcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaatggtatcagacaagaaaccgagggaaacgcccctaaagctcctgatctatgctgcatccagtttcgacaaaggtcggggtcccatcaaggttcagtggcagtggatcgtgggacagtatttcactctcaccatcaacagtctgacaacctagaagtattttgactaacttactactgtacaactagtactttcacacttacccctcgtctacgtttcgg

SEQ ID NO: 444134 - DNA, 245 bp, Homo sapiens
  misc_feature: NA.3.52.E08.2.454.light.2.nb
  modified_base (229)..(229): a, c, t, g, unknown or other
cacgacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgtacttggtcgggcgtactcggtacggttttaacaggtattggttagtctggtatcagcaagaaaccgagggaaacncccctgacgttcctga

SEQ ID NO: 444135 - DNA, 285 bp, Homo sapiens
  misc_feature: NA.3.53.E09.1.454.light.2.nb
acaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttatacagctaaccaaacaaaaagtaactacttaggtggtaaccagcagaaaccaggcagcctctaagctgctcattacctggcatctacccgggaatctcggggtccctgaccg

SEQ ID NO: 444136 - DNA, 414 bp, Homo sapiens
  misc_feature: NA.3.55.E11.1.454.light.2.nb
  modified_base (139)..(139): a, c, t, g, unknown or other
tgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcaagaaacctggccaggcctcccaggcctcctcatctatgctgcatccaccagggccactggtactcccagcccccaggttcagtggcaggtgggtctggggacagagttcattctcaccatcagcagcctgcagtctagagtattttgactaatttattactgtacagcaagtataataacgtggtaggacgttcggaccgaagggaccaaaggta

SEQ ID NO: 444137 - DNA, 296 bp, Homo sapiens
  misc_feature: NA.3.57.F02.1.454.light.2.nb
gtctccactcccgccttgacgggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggcttcggcggcgggaccaagctgaccgtctatgtcaacccaagctggcccctggtcactctgttcccaccctcctcgacgtgcgtct

SEQ ID NO: 444138 - DNA, 399 bp, Homo sapiens
  misc_feature: NA.3.70.G04.2.454.light.2.nb
  modified_base (305)..(305): a, c, t, g, unknown or other
ctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttagggccacttagcctggtaccagcagaaacctggccagcctcccagtctcctcatctatggagcacacaacagggccactggcatcccagccaggttcagtggcaggtcgggtctgggacagacttccaccctnatcatcagccgcctagacgcctagaagtatttgctagtttattactgtcagctagggtttacttcgtcggtccctacgtttccggcccttaggg

SEQ ID NO: 444139 - DNA, 374 bp, Homo sapiens
  misc_feature: NA.3.72.G06.1.454.light.2.nb
  modified_base (139)..(139): a, c, t, g, unknown or other
  modified_base (231)..(231): a, c, t, g, unknown or other
  modified_base (292)..(292): a, c, t, g, unknown or other
tgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaacctggccaggctcccaggctcctcatttangatgcatccaacgaggccactggcatcccagccaggttcagtggcaggtgggtctgggacngacttcactctcacatcagcagcctagacgcctagaagtattttgctagtttattactgtcagcagcgtagcaactggcctc

SEQ ID NO: 444140 - DNA, 353 bp, Homo sapiens
  misc_feature: NA.3.77.G11.1.454.light.2.nb
ctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcacgtggtctcccaggcaggttcagtggcaggtggatcgtgggcagaattcacgctcacatcatcaggctgcggtctgacacttcgctagtctatttctgtcaac

SEQ ID NO: 444141 - DNA, 429 bp, Homo sapiens
  misc_feature: NA.3.79.H02.1.454.light.2.nb
  modified_base (183)..(183): a, c, t, g, unknown or other
  modified_base (279)..(279): a, c, t, g, unknown or other
  modified_base (367)..(367): a, c, t, g, unknown or other
aggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctggtaccaacaacaccagcaaagccccaaactcatcatttatgatgtcactgctcggccctcgagggtttctcatcgccttttcngctccaagtctggcaccacggcctccctgaccatctcggggctccagctgagacgaggctgcttatactgcagctcatatacaaggancacactctcgtgtatttggtggaggaccaagctcgaccgtcctaggtcagcccaaggcctcg

SEQ ID NO: 444142 - DNA, 272 bp, Homo sapiens
  misc_feature: NA.3.79.H02.2.454.light.2.nb
aggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgaccattggtattataactatgtctcctggtaccagcagcaccaggcaaacgcccccaaatcatgatttatgatgtcacaaagcggccctcgaggggtccctga

SEQ ID NO: 444143 - DNA, 369 bp, Homo sapiens
  misc_feature: NA.3.82.H05.2.454.light.2.nb
cccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagtatggttagtctggtatcagcagaaaccagggaaagcccctgagttcctgatgtctgctgcatccacctgacaaagtggagtcccatccagattcagctcaagtgaatcgtgggacagagttcactctcacatcagcagcctgcagcctagaagtattttgactaacttactattgtacaacaggctgacagtc

SEQ ID NO: 444144 - DNA, 288 bp, Homo sapiens
  misc_feature: NA.3.87.H10.2.454.light.2.nb
caggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggaaaccaacagtgacgttgtatttttaatctctgtctctgtaccaacaacaccagacaaacgcccccaaactcatcatttatgatgtcactgctccggccctcgtacggggtttctctacttccgtcttt

SEQ ID NO: 444145 - DNA, 204 bp, Homo sapiens
  misc_feature: NA.3.87.H10.4.454.light.2.nb
gtctccactcccgccttgacggggctgctatctgcctccctgaccatctctgggctccaggctgaggacgaggctgattatttctgcagctcatacacaaccggcaccactgtcgtggttttcggtggaggaccaagctgaccgtctaggtcagcccaaggctgccccctggtcactctgttcccaccctcctcgagtgcgtct

SEQ ID NO: 444146 - DNA, 424 bp, Homo sapiens
  misc_feature: NA.3.88.H11.1.454.light.2.nb
gacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaacgcccctaagctcctgatctatgctgcatccactttgactaaacgtcggggtcccatccaggttcagcggcgaggggatcgtgggacagatttcactctcacatcagcagcctgcagcctagaagtattttgactaacttactattgtacaacaggactaactacgttttccctttaaattccgtttacggacctaaagggacacgacttgga

SEQ ID NO: 444147 - DNA, 290 bp, Homo sapiens
  misc_feature: NA.3.9.A09.1.454.light.2.nb
tccaactacttagcctggcaccaacagaggcctggccaggctcccaggctcctcatctatggtgcttccagcagggcccctggcatcccagacaggttcagtggcagtgggtctgggacagacttcactctcaccatcagcagactggagcctgaagatgttgctgtgtattactgtcatcagtataataactctccgctcactttcggcggagggaccaaagtggagctcagacgaactgtggctgcaccatctgtcttcattccttcccgccatctgagagtgcgtct

SEQ ID NO: 444148 - DNA, 211 bp, Homo sapiens
  misc_feature: NA.41.1.A01.1.454.light.2.nb
gacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtatgatatctggttgctggtatcagcagaaaccagggaatcgacccctaaggtcct

SEQ ID NO: 444149 - DNA, 191 bp, Homo sapiens
  misc_feature: NA.41.2.A02.1.454.light.2.nb
caggggcagcaagatggcgctgcagacccaggtcttcatttctctgttgctctggatctctggagcctacggggacatcgtgctgacccagtccccagactccctggctgtgtctctggcgagaggccaccatcacctgcaagtccagccacaaccttggatacaggtccaagttgagtattacgttggtt

SEQ ID NO: 444150 - DNA, 346 bp, Homo sapiens
  misc_feature: NA.41.38.D05.1.454.light.2.nb
  modified_base (295)..(295): a, c, t, g, unknown or other
aaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcgagggatccctgagcgattctcctggctccaactcgtagggaacncggccaccctgaccatcagcagggtcgaaggccggggatggaggccgacta

SEQ ID NO: 444151 - DNA, 288 bp, Homo sapiens
  misc_feature: NA.41.5.A05.2.454.light.2.nb
  modified_base (252)..(252): a, c, t, g, unknown or other
agcgctctcaggacgtcaccaccatggcctgggctctgctcctcctcaccctcctcactcagggcacaggtcctgggcccagtctgccctgactcagcctcctccgtgtccgggtctcctggacagtcagtcaccatctcctgcactggaaccaacagtgacgtcggtcgttttgaccgtgtctcctggtaccagcagaccccagaaacacgacccccaaatcattattagcgtcaatgttcgccttcggtntccctgacgcgcttctctcgggtccccaagtctggc

SEQ ID NO: 444152 - DNA, 246 bp, Homo sapiens
  misc_feature: NA.41.65.F10.1.454.light.2.nb
taggacccagacggaaccatggaagccccagcgcagcttctcttcctcctgctactctggctcccagataccactggagaaatagtgatgacgcagtctccagccaccctgtctgtgtctccgaggggaaaggccaccctctcctgcagggccagtcagagtgtaccagcaacttgcctggtaccacagaacctgggcaggctccaggctcctcatctatggaacatccaccaggcccagtggtac

SEQ ID NO: 444153 - DNA, 379 bp, Homo sapiens
  misc_feature: NA.41.67.G01.1.454.light.2.nb
acaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttatacacctccaacaatcaccactactatcatgtatcaacacagaccagggcagcctcctaagttgctcatttactgggcatccgacccgggaatccggggtcccctgagcgattcagtgcagcgggtctgggacagatttcactctcaccatcagcagcctgcaacctgaagatgtggctagtttattactgtcagctaatattataga

SEQ ID NO: 444154 - DNA, 295 bp, Homo sapiens
  misc_feature: NA.41.7.A07.1.454.light.2.nb
  modified_base (257)..(257): a, c, t, g, unknown or other
  modified_base (277)..(277): a, c, t, g, unknown or other
gttcatcttctcaccatgagactccctgctcagctcctggggctgctaatgctctggatccctggattgagtgcggatattgtggtgacccagactccactctctctgtctgtcacccctggacagtcggcctccatctcctgcacgtctgatcggagcctcttacatactaagtgggaatacttattgattggtacctacagaggccaggccagtcgccgcagctcctagtccagcaaggttccagccgtctttcnggactgtcagacaggaatcngtgctccggctcagaaac

SEQ ID NO: 444155 - DNA, 408 bp, Homo sapiens
  misc_feature: NA.41.75.G09.1.454.light.2.nb
aggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacacatttcactctcaccatcagcagcctgccagcctggagtatttcgcgtacttattactgaccctaaactaattatctttttttaacgtcccgtttaacgttaggtttttcggacccggtaacgggggtaccctaacggtccgttagggacgtagtaaccgaaaa

SEQ ID NO: 444156 - DNA, 219 bp, Homo sapiens
  misc_feature: NA.41.78.H01.3.454.light.2.nb
caggaagcagcatcggaggtgcctcagccatggcatggatccctctcttcctcggcgtccttgcttactgcacgagggtccgggcctcctctgacctgactcagccatcctcactcgtccgtgtccccaggacacacagtcactattacctgctcgtaggggaaaacttgagtagtaattaaatttgcttcgtggtatcagcagaggcaggccagcccc

SEQ ID NO: 444157 - DNA, 344 bp, Homo sapiens
  misc_feature: NA.41.86.H09.2.454.light.2.nb
aggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggacctgtcaccagtggtctattttcccatggctccaacagaagcctggccaacgcccccaggacactaatttatgatataactatagactagtcctggacacctcgcccgtcttctcacggcctccccgtccgttacggggacctaaacggcccgtccctcggtacccctttccgagtcgccg

SEQ ID NO: 444158 - DNA, 272 bp, Homo sapiens
  misc_feature: NA.41.87.H10.1.454.light.2.nb
  modified_base (190)..(190): a, c, t, g, unknown or other
cttctcagttcatcttctcaccatgaggctccctgctcagctcctggggctgctaatgctctggatccctggatccagtgcggatattgtgatgtcccagactccactctctctgtcagtcacccctggacagccggcctccatctcctgcaagtccagtcagacgccctcctacttggtgatggaaacngctatttgactggtacctgcagagggcaggccagtctccacggctcctaatgtatgaggcttccgagtacgggtctcgtgga

SEQ ID NO: 444159 - DNA, 398 bp, Homo sapiens
  misc_feature: NA.44.1.A01.1.454.light.2.nb
gacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattgatatctggttgcctggtatcagcagaaaccagggaatgcccctaaggtcctgatctataaggcgtctagttagaaagtggggtccatcaaggttcagccggcagtggatcgtgggacagaattcactctcaccatcagcagcctgcagcctgatgtatttgctaaacttattactgaccaaacagtaataaagtagttattctactagtagttttggccgtaagggggaccaaggc

SEQ ID NO: 444160 - DNA, 349 bp, Homo sapiens
  misc_feature: NA.44.1.A01.2.454.light.2.nb
gacaagtcaaggcaggaagatgttgccatcacaactcattgggtttctgctgctctgggttccagcctccaggggtgaaattgtgctgactcagtctccagactttcagtctgtgactccaaaggagaaagtcaccgtcacctgccgggccagtcagagcattgctagtagcttacactggtcccagcaagaaaccagatcagtccaaccaaacctcctacatacaagtactaccttccccgtcatctcgacggggtcccctgagttcagtggcagtggatctgcgacagtctttccaccctcaccatacaaatacgcctggaagctagaagatgctgcaacgtattac

SEQ ID NO: 444161 - DNA, 366 bp, Homo sapiens
  misc_feature: NA.44.10.A10.1.454.light.2.nb
  modified_base (298)..(298): a, c, t, g, unknown or other
gagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatattggcgccgactacttagcctggtaccagcagagacctggccagcctcccaggcctcctcatccacggtgcactccaaacacgggccacgtggctccgtccccctgaccaggttccagtggcnggtgggtctggggaccagacttcactctcaccatcagcagcctggacgcctgaagtagtttgtgattg

SEQ ID NO: 444162 - DNA, 244 bp, Homo sapiens
  misc_feature: NA.44.10.A10.2.454.light.2.nb
  modified_base (122)..(122): a, c, t, g, unknown or other
cactcaggacaatctccagcatggcctggtctcctctcctcctcactctcctcgctcactgcacagggtcctgggcccagtctgtgctgacgcagccgccctcagtgtctggggccccgggnaggaggtcaccatctcctgcacgtgggagcagctccaattcgggcagattatgatgtgcactggtaccagcaacttccaaggaacacgacccccaaatcctacatctaatacggtaaacaac

SEQ ID NO: 444163 - DNA, 354 bp, Homo sapiens
  misc_feature: NA.44.11.A11.1.454.light.2.nb
cagcatcggaggtgcctcagccatggcatggatccctctcttcctcggcgtccttgcttactgcacagggtccggggcctcctctgacctgactcagccatcctcactgtccgtgtccccaggacacacagtcactattacctgctctagggaaacttgagtgataaattgcttctggtatcagcagaggccaggccagccccctatgctggtcatctttcaggataataagcggccctcgagggactccctgagcgcttctcctggctccaactctgggaacacggccactctgaccatcagcgcgacccagcctctgatgaggctgactattacgtcagacgtgggaaagtg

SEQ ID NO: 444164 - DNA, 329 bp, Homo sapiens
  misc_feature: NA.44.12.B01.3.454.light.2.nb
aagcagagcctggagcatctccactatggcctgggctccactacttctcaccctcctcgctcactgcacaggttcttgggccaattttatgctgactccacccccctctgtgtcggagtcgtccggggaagacggtaaccatctcctgcacccgcagcactggcagcattgccagcaactttgtgcagtggtaccagcagcgcccgggcagtcgcccccacactgtgatctatgaggactacccaacgaccctcgtcggggtccctgactcggttctcgtcggctcatcgacaacgctcctcaactctcgccctccctcacccatctct

SEQ ID NO: 444165 - DNA, 321 bp, Homo sapiens
  misc_feature: NA.44.12.B01.4.454.light.2.nb
tggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagccctccctggccatcactgggctccaggctgaagatgagggtgattattactgccagtcctatgacagcagcctcgagtggttgggtgttcggcggaggacaagctcgaaccgtcgtgggtcacgcccgaagg

SEQ ID NO: 444166 - DNA, 387 bp, Homo sapiens
  misc_feature: NA.44.14.B03.1.454.light.2.nb
  modified_base (300)..(300): a, c, t, g, unknown or other
ggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagcttggtaccagcagaagccaggacagcctcctaagttgctcttttactgggcttctacccgggaatccggggtccctgaccgattcagtgcagcggtctgggacngatttcactctcaccatcaacagcctgcaggctgaagatgtgctactttatttctgtctgcaatattatactccctgtacctagttt

SEQ ID NO: 444167 - DNA, 287 bp, Homo sapiens
  misc_feature: NA.44.15.B04.2.454.light.2.nb
  modified_base (246)..(246): a, c, t, g, unknown or other
cagaagcagagttctggggtgtctccaccatggcctggacccctctctggctcactctcctcactctttgcatagattctgtggtttcttctgagctgactcaggaccctgctgtgtctgtggccttgggacagacagtcacgatcacatgccagggaacagcctcagaggtcattatgcaagctggtaccagcagaagccaggacaggcccctgtccttgtcatctataggtaaaatgtcgcctnaggaactcccagaccgattctctgctccacctcagagacac

SEQ ID NO: 444168 - DNA, 357 bp, Homo sapiens
  misc_feature: NA.44.17.B06.1.454.light.2.nb
gctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggacaaaccccccaaactcttgattcatgaaatctctaagcggccctctgggatttctgatcgccttctctggctccgaggtccgcaacacggcctccctgacaatctctgggctccagcctgaggacgaggactaaatatttctagttcctca

SEQ ID NO: 444169 - DNA, 405 bp, Homo sapiens
  misc_feature: NA.44.19.B08.1.454.light.2.nb
aaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtattaaatggtatcagcaacaaaccgaggacacgacccctaaactcctagactccaggacctcgtacctaaagtttacggaaacgtacgggggttacccctagtaaacggggtttccccgaagggtaccggggtaaaggttcggggttacgttacgggggtaaccttacggggtttttttcctaccgtttccgtttaccggttacctaacgttaccctaaaaccctaaaccc

SEQ ID NO: 444170 - DNA, 358 bp, Homo sapiens
  misc_feature: NA.44.19.B08.2.454.light.2.nb
aaccaggacacagcatggacatgagggtccctgctcagctcctggggctcctgctgctctggctctcaggtgccagatgtgacatccagatgacccagtctccaccctccctgtctgcatccattggagacagagtcaccatcacttgccaggcgagtcagggcatcactaagtattaaatggtatcagcaacaaaccgaggacacgacccctaaactcctagactccaggacctcgtacctaaagtttacggaaacgtacggggtccctacgaaggttccagcggaagtgggtctgggactgttttcctctcgtcatcaacaacctacagcctagaagatgtagcaaacatattact

SEQ ID NO: 444171 - DNA, 249 bp, Homo sapiens
  misc_feature: NA.44.19.B08.4.454.light.2.nb
agcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgactagttgggatatataaccttgtctctggtatcaacaacatcaggacaaacgcccccaaatcattacttttgagtccagtgagcgg

SEQ ID NO: 444172 - DNA, 414 bp, Homo sapiens
  misc_feature: NA.44.2.A02.1.454.light.2.nb
caggggcagcaagatggcgctgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaagttgagaattacttggtttgtatcaaacagaaggcaggacagcctcctaggttcctcatttacggacatccaggcgggcagtcccggggtcctgaccgattccagcgccagcgggtctgggcagacttcgcactcaccatcaacgcctgcagggtgaagatcttgactaacttattactgtcagctagtatttgaaacggcccctacacgtttcgggcgggggaccaggggtggaactcga

SEQ ID NO: 444173 - DNA, 449 bp, Homo sapiens
  misc_feature: NA.44.23.C01.4.454.light.2.nb
accctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttgcctggttacaaacggaaaaaggggggacggcccctaaggtcctcgtctctcgtgaaaccagactggaaggtagagtcccgtcaggttcagtgccagtccaggtggtgggccccggagtccactctcaccattgcgacctgcggcctgaagattctgctaacttatttctgtcagcagtatcatagtgccccgttctacttttggcctagggggaccaagctggaaatcaaaacgactagtggctgcaccatctgttcttcaat

SEQ ID NO: 444174 - DNA, 362 bp, Homo sapiens
  misc_feature: NA.44.24.C02.1.454.light.2.nb
aggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctctggtaccagcatcacccaggcacacgcccccagactcgtgattttgagtcaatacgcgcccctcacggggtcccgatcggttctccgtggctcaagtctggcacgacggcctccctcgacccgtctctgggcctcgaggctgacgatgaggctgattatactgcagct

SEQ ID NO: 444175 - DNA, 292 bp, Homo sapiens
  misc_feature: NA.44.25.C03.1.454.light.2.nb
aagaggcagcctctcgggaatctccaccatggcctgggctctgctcctcctcaccctcctcactcagggcacaggtcctgggctcagtctgccctggctcagcctccctccgtgtctggttctcctggacagtcgatcaccatctcctgcactgggtccagcaatgacagttggggagatataaccttgtctcctggtatcaacaacatccaggacaaacgcccccaaatcatacttttgagtccagtgagcggccgtcaggtgttctaactcgtcttctctggctcagtct

SEQ ID NO: 444176 - DNA, 195 bp, Homo sapiens
  misc_feature: NA.44.25.C03.2.454.light.2.nb
  modified_base (124)..(124): a, c, t, g, unknown or other
aagaggcagcctctcgggaatctccaccatggcctgggctctgctcctcctcaccctcctcactcagggcacagggtcctgggcccagtctgccctgactcagcctgcctccgtgtctgggtcncctggacagtcggtcaccatctcctgcactggagccagcggtaatattcttagtcttacttgtctctgtat

SEQ ID NO: 444177 - DNA, 362 bp, Homo sapiens
  misc_feature: NA.44.25.C03.3.454.light.2.nb
tggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgaggtgattattactgccagtcctatgacagcagcctcagtggttgggtgttcggcggagggaccaagctgaccgtcctgggtcagcccaaggctcgccccctggtcactctcgttcccaccctcctctatactactgt

SEQ ID NO: 444178 - DNA, 316 bp, Homo sapiens
  misc_feature: NA.44.25.C03.4.454.light.2.nb
ctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctaggggaaacttgagtgataaattgcttctggtatcagcagaggcaggccagcccctatcgctggtcatctttcaggataataagcggccctcgagggatccctgagcgtcttctctggctccaactcgtgggaacacggccactctcgaccatcagccg

SEQ ID NO: 444179 - DNA, 181 bp, Homo sapiens
  misc_feature: NA.44.25.C03.5.454.light.2.nb
  modified_base (158)..(158): a, c, t, g, unknown or other
aagaggcagcactcaggacaatctccagcatggcctggtctcctctcctcctcactctcctcgctcactgcacagggtcctgggcccagtctgtgctgacgcagccgccctcagtgtcgtggggccccgggagaggtcaccatctcctgcactgggancagctccaatatcgggccagatt

SEQ ID NO: 444180 - DNA, 453 bp, Homo sapiens
  misc_feature: NA.44.27.C05.6.454.light.2.nb
  modified_base (127)..(127): a, c, t, g, unknown or other
caagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaacgcccccaaactcatcatctatgagcctataagaggccctcaggggtttctaatcgcttcacctgcctccaagtccggcaacacggcctccctgacaatctctgggctccaggctgagacgaggctgattattattgttgctcagatgttcgtcgcatcacttatgtcttcggaagtgggaccaaggtcaccgtctaggtcagcccaaggcccaacccactcgtcactctccg

SEQ ID NO: 444181 - DNA, 423 bp, Homo sapiens
  misc_feature: NA.44.28.C06.1.454.light.2.nb
caagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacgcccccaaactcatcatctatgagcctataagaggccctgaggggtttctaatcgcttccactgcctccaagtccggcacacggcctccctgacaatctctgggctccaggctgagacgaggctgattattattgttgctcagatgttcgtcgcatcacttatgtcttcggaagtgggaccaaggtcaccgtctagtcagcc

SEQ ID NO: 444182 - DNA, 364 bp, Homo sapiens
  misc_feature: NA.44.28.C06.2.454.light.2.nb
ggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaacacgacccccaaatcattattatgcgtcaatgttccgccctttccggtcgtccctgacgcgtcttctccgtgggtccaagtctggcaacgccggcctccctgacccatctctcgggctccgaggctgaggacgaggctgattattac

SEQ ID NO: 444183 - DNA, 339 bp, Homo sapiens
  misc_feature: NA.44.28.C06.3.454.light.2.nb
aggcagcactcaggacaatctccagcatggcctggtctcctctcctcctcactctcctcgctcactgcacagggtcctgggcccactctgtgctgacgcagccgccctcagtgtctggggccccgggcaggagggtcaccatctcctgcactgggagcagatccaacatcgggacagattctgatgtccactggtaccaacaccttccaggaacacgcccccaaactcctcatctttaggaacaactatcggccctcacggggtccctgaccgattcctctggctccaagtctggcacctcagccctccctggccatcactgggctccaggctagaaga

SEQ ID NO: 444184 - DNA, 306 bp, Homo sapiens
  misc_feature: NA.44.29.C07.3.454.light.2.nb
gaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctcctgtaccagcatcacccagcacacgcccccagactcgtgtattttgaggtcaataacgccgcccctcgacggggtcccgagtcggttctccgtggctcaagtctacggacaacg

SEQ ID NO: 444185 - DNA, 331 bp, Homo sapiens
  misc_feature: NA.44.33.C11.4.454.light.2.nb
ggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgacattggtgttataacttgtctctgtaccaacaccaccaggacaaacgccccaaattcatcatttagatgtcagtaagcggccctcgagggtccctgactcgcttcctctgctccaagtctggcaacacggcctccctgaccatctctgggcctccaggctga

SEQ ID NO: 444186 - DNA, 368 bp, Homo sapiens
  misc_feature: NA.44.34.D01.1.454.light.2.nb
  modified_base (272)..(272): a, c, t, g, unknown or other
  modified_base (364)..(364): a, c, t, g, unknown or other
ctctctcagtcaggacacagcatggacatgagggtccctgctcagctcctgggactcctgctgctctggctcccagatactagatgtgacttccagatgacccagtctccatcctccctgtctgcatctgtgggaacagagtcaccatcacttgccgggcgagtcaggccattagcaattattagcctggtatcagcaagaaaccaggaaacctcctaacctcctgatctttgctgcatccactttgcaatcaggggtcccatctcggttcngcgcagtgatcgtgggacagtattctctctcaccatcagcagcctgcagcctgaagtatgttgactaacttattactgtacaaaagtacaanaagt

SEQ ID NO: 444187 - DNA, 378 bp, Homo sapiens
  misc_feature: NA.44.35.D02.1.454.light.2.nb
  modified_base (181)..(181): a, c, t, g, unknown or other
agaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttagaaaatntaaccttgtctcttggtaccaagtatacccaggtaaacccccaaactccttcttatgaagtcaataagcggccctcgggcatttctcatcgcttctcaggctccaagtctggcaacacggcctcgttgataatttctgcctctgcctgacgacgaggccgactattatgctgctcatatgcgggtcctagattagtt

SEQ ID NO: 444188 - DNA, 304 bp, Homo sapiens
  misc_feature: NA.44.35.D02.2.454.light.2.nb
agaggcagcgctctcgggacgtctccaccatggcctgggctctgctgctcctcactctcctgactcaggacacagggacctgggcccagtccgccctgactcagccagcctccgtgtctgggtctcctggacagtcggtcaccatctcctgcactggagccagcggtaatattcttagtcttaactttgtctcctggtatcaacatcatccagtaaacgcccccaaatcatcatctatgagcctataagagcctcagggtttctaatcgcttccactgcctccaagtccgacacacggcctccc

SEQ ID NO: 444189 - DNA, 421 bp, Homo sapiens
  misc_feature: NA.44.35.D02.4.454.light.2.nb
ctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaacttgagtgataaatttgcttctggtatcagcagaggccaggccagccccctatcgctggtcatctttcaggataataagcggccctgagggactccctgagcgcttcctctggctccaactctgggacacggccactctgaccatcagcgcgacccagcctcgtcggatgaggctgactattactgtcagacgtgggaaatgactaagttgggtgttcgggcgggtaggggaccaaggcttgaccgttcgtcggtcac

SEQ ID NO: 444190 - DNA, 385 bp, Homo sapiens
  misc_feature: NA.44.36.D03.1.454.light.2.nb
acaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataacctgtctcctgtatcaaacaacatccaggaccaaacgcccccaaatcaatacttttgagtccagtgagcggccgtcaggttgtttctaatcgcttctctggctcaagtctggccacacggccctccctgtcgatctcgtgggctccggctgaggacgaggctggactattactgcgctcatttacaacttcttagagt

SEQ ID NO: 444191 - DNA, 304 bp, Homo sapiens
  misc_feature: NA.44.36.D03.11.454.light.2.nb
cacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttagaaaatataaccttgtctcttggtaccaagtatacccacgtaaaccccccaaactccttcttatgaagtcaataagcggccctcgggctatttctcatcgcttctcacggctccaagtctggcaac

SEQ ID NO: 444192 - DNA, 294 bp, Homo sapiens
  misc_feature: NA.44.36.D03.2.454.light.2.nb
acaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggaccagcggtaatattcttagtcttaactttgtctcctggtatcaacatcatccaggtaaacgcccccaaatcatcatctatgaggcctataagacgccctgaggggtttctaactcgcttcactgcctcagtcc

SEQ ID NO: 444193 - DNA, 411 bp, Homo sapiens
  misc_feature: NA.44.37.D04.1.454.light.2.nb
  modified_base (136)..(136): a, c, t, g, unknown or other
gctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaaccaacagaaacctggccaggctcccaggctcctcatctatgatgcatccaacagggtcactggcaccccagacaggttcagtggccaggtgggtctggggacagacttcactctcaccgtcagcaatgtacagcctgaagtatttgctagtttattactgtcagcagtcgttcctccacggccgctcacgtttcgggcgggggaccaagggtggagaa

SEQ ID NO: 444194 - DNA, 274 bp, Homo sapiens
  misc_feature: NA.44.38.D05.2.454.light.2.nb
agaggcagcgctctcgggacgtctccaccatggcctgggctctgctgctcctcactctcctcacccaggacacagggtcctgggcccagtctgccctgactcagcctgcctccgtgtctgggtccctggacagtcggtcaccatctcctgcactggagccagcgtaatattcttagtcttaacttgtctcctggtatcaacatcatccaggtaaacgcccccaaatcatcatctatgagcctaataagagccctcgaggggtttctaatcgctt

SEQ ID NO: 444195 - DNA, 338 bp, Homo sapiens
  misc_feature: NA.44.38.D05.4.454.light.2.nb
  modified_base (300)..(300): a, c, t, g, unknown or other
aaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattaccgtggtagggggaaacaacattaggaaagtaaaagtgtgcactggtaccagcagaagccaggccaggcccctgtgctggtcatctattatgatagcgaccggccctcagggactccctgagcgattctcctggctccaactcgtagggaacncggccaccctgaccatcagcagggtcgaaggccgggga

SEQ ID NO: 444196 - DNA, 421 bp, Homo sapiens
  misc_feature: NA.44.39.D06.2.454.light.2.nb
acaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggacaaacgacccccaaatcattacttttgagtccagtgagcggccgtcaggttcgtttctaatcgcttctctggctccaagtctggccacacggccctccctgtcgatctctgggcctccggcctgaggacgaggctgactattactgcggctcatttacaactcttgagtacttgggtcgttcgggcggtacgggactcaccgt

SEQ ID NO: 444197 - DNA, 409 bp, Homo sapiens
  misc_feature: NA.44.4.A04.1.454.light.2.nb
ggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttcacagctccagcaataggaactacttacttggtaccaacagaaaccagggcagcctccagactactcatttacggcatccgtacccgggaatccggggtcctgaccgattccagtggcagcggtctgggcagatttcactctcaccatcagcagcctgcaggctgaagatgtggcttgtttattactgtcaacaagagcatcttcctccctattctttggccaggggtaccaaagctggagatca

SEQ ID NO: 444198 - DNA, 404 bp, Homo sapiens
  misc_feature: NA.44.41.D08.1.454.light.2.nb
gctcagttaggacccagagggaaccatggaagccccagctcagcttctcttcctcctgctactctggctcccagataccaccggggaaattgtgttgacacaatctccagccaccctgtctttgtctccaggggaaaggccaccctctcctgcagggccagtcagagtgttaggaactacttagcctggtatcaacagacacctggccaggctcccaggctcctcatctatgatgcatccaataggggccgcgggcatcccagccaggttcagtggcaggtcgggtctgagacagacttcactctcaccatcagcgcctagagccggagtatttgctagtttattactgtcaacacgtagcgactggcctaggtactagtttgcgaggggaccaagctggagct

SEQ ID NO: 444199 - DNA, 379 bp, Homo sapiens
  misc_feature: NA.44.42.D09.1.454.light.2.nb
agaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaagcccccaaactcattacttttgagtccagtgagcggccgtcaggtgtttctaatcgcttctctggctcaagtctggccacacggcctccctgtcgatctctgggcctccggcctgaggacgaggctgactattactggcgtctcatttacaacttcttaga

SEQ ID NO: 444200 - DNA, 342 bp, Homo sapiens
  misc_feature: NA.44.5.A05.1.454.light.2.nb
agttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggtccactcgggcctccggggtctctgactaggttcagtgccagtgcatcacacacagtatttcacactgcacatcagcagagtggaggctgacgatgttgggtcta

SEQ ID NO: 444201 - DNA, 310 bp, Homo sapiens
  misc_feature: NA.44.5.A05.2.454.light.2.nb
gcgctctcaggacgtcaccaccatggcctgggctctgctcctcctcaccctcctcactcaggacacagggtcctgggcccagtctgccctgactcagcctgcctccgcgtccgggtctgtcggtcagtcagtcaccatctcctgcactggaaccagcaatttcattggtaatcatgactatgtctcctggtaccagcatcacccaggcacacgcccccagactcgtgtatttttgaggtcaataacgccgccctcgacggggtcccgatcggttctccgtggctccaagtctaggcacgaccggcctccc

SEQ ID NO: 444202 - DNA, 275 bp, Homo sapiens
  misc_feature: NA.44.5.A05.3.454.light.2.nb
gcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtgttataactatgtctctgtaccaacaacaccaggacaaacgccccaaatcatgattcatgatgtacagtaactccggccctcgtaggggtttctggtcgtctt

SEQ ID NO: 444203 - DNA, 329 bp, Homo sapiens
  misc_feature: NA.44.53.E09.3.454.light.2.nb
agaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggaccagcggtaatattcttagtcttaacttgtctcctggtatcaacatcatccagtaaacgcccccaaatcatcatctatgagcctataagagccctagggtttctaatcgcttccactgcctccaagtccggacacacggcctccctagacaatctctgggctccaggctga

SEQ ID NO: 444204 - DNA, 410 bp, Homo sapiens
  misc_feature: NA.44.59.F04.1.454.light.2.nb
  modified_base (309)..(309): a, c, t, g, unknown or other
ggtggtctccactcccgcccagtctgtgctgactcagccatcctcagcgtctgggacccccgggcagacggtcacgatcttttgttctggaagtaggtccaacatcggaagtaattacgtatactggtatcggcaattcacaggagcggtccccagacccctcatctatagggagaatcagcggccctcaggggtccctgaccgattctctgcctcaagtctggcacctcagcctccctggccatcagtgggctccggtccgaggatgaggctgatttatttctgtgcggccttgggatgacatcctgngtggactgctattcgggcggagggaccaagctgaccgtctaagtcagcccaaggctcgccccctcggtcactctcgttccccccctcctctatactactgt

SEQ ID NO: 444205 - DNA, 354 bp, Homo sapiens
  misc_feature: NA.44.62.F07.2.454.light.2.nb
cccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggcaagtcagggcataaacagtgctttggcctggtatcagcaagaaaccaggaaaactcctagaactcctgatctatgatgcctcagtttaggaaagtggacgtccatcaaggttcagcggcagtggatcgtgggacagtatttcactctcaccatcagcagcctgcagcctagagtattttagactaaacttattactg

SEQ ID NO: 444206 - DNA, 188 bp, Homo sapiens
  misc_feature: NA.44.62.F07.3.454.light.2.nb
acagagtcaccatcacttgccgggcaagtcagggcataaacagtgctttggcctggtatcagcagaaaccagggaaactcctgaactcctgatctatgatgcctcagttggaagtggatcccatcaaggtcagcgcagtgatctgggacagtattcactctcaccatcagcagcctgcacgcctagaa

SEQ ID NO: 444207 - DNA, 416 bp, Homo sapiens
  misc_feature: NA.44.65.F10.1.454.light.2.nb
taggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggttcagtcggcagtgggtctgggacaggttcactctcaccatcagcagcctgcagtctagaagtatttgctagtttattactgtcagcagtataatgactggcctcccgttcggccaagggcaacgactaggagattaaacgacttgttggctgc

SEQ ID NO: 444208 - DNA, 407 bp, Homo sapiens
  misc_feature: NA.44.65.F10.2.454.light.2.nb
taggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttaccagcaacttagcctggtaccacagaacctgggcaggctcccaggctcctcatctatggaacatccaccagggccactggtactcccacccaggttcagtggcaggtgggtccccggacagagttcactctcaaccatcagcgcctgcagtctgaggtatttgctagtttattactgtcagcagtataataactggcctctcacttcggcgggggacaaggtggagatacgaaagaactgt

SEQ ID NO: 444209 - DNA, 321 bp, Homo sapiens
  misc_feature: NA.44.66.F11.1.454.light.2.nb
tccagccacaaccttggatacaggtccaacgttgagaattacttggtttggtatcaacagaaggcaggacagcctcctaggttcctcatttacgggacatccaggcgggcatccggggtccctgaccgattcagcgccagcgggtctgggacagacttcgcactcaccatcaacggcctgcagggtaaagatcttgcaacttattactgtcagcagtatttgaaaggcccctcactttcggcggggggaccagggtggaactcagacgaactgtggctgcaccatctcgtcttcatcttcccgccatctgatatatactgt

SEQ ID NO: 444210 - DNA, 385 bp, Homo sapiens
  misc_feature: NA.44.67.G01.3.454.light.2.nb
  modified_base (170)..(170): a, c, t, g, unknown or other
aggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacaatcaccactacttatcatgtatcaacacagaccagggcagcctcctaagttgctcatttacgtgggcatccgacccgggaatccggggtcccctgagcgattcagtgcagcgggtctgggacagatttcactctcaccatcagcagcctgcaacctgaagatgtggctagtttatactgtcagcaaatatataggactcctcg

SEQ ID NO: 444211 - DNA, 400 bp, Homo sapiens
  misc_feature: NA.44.70.G04.2.454.light.2.nb
tcagttaggacccagagggaaccatggaagccccagctcagcttctcttcctcctgctactctggctcccagataccaccggggaaattgtgttgacacaatctccagccaccctgtctttgtctccaggggaagccacctctcctgcagggccagtcagagtgttaggaactacttagcctggtatcaacagacacctggccaggctcccaggctcctcatctatgatgcatccaagtcggggccgcgggcatccccagccaggttcagtggcaggtgggtctggagacagacttcactctcaccatcagcgctagagcggaagtatttgctagtttattactgtcaacacgtagcgacgtcgggcctaggtactagtttggaccgtaaggggaccaag

SEQ ID NO: 444212 - DNA, 443 bp, Homo sapiens
  misc_feature: NA.44.71.G05.1.454.light.2.nb
ctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgtttgaccgtgtctcctggtaccagcagaccccagaaaccacgacccccaaatcattatttatgcgtcaatgttccgcccttcggtcgtccctgagcgtcttcctcgtgggtccaagtctggcacacggcctccctgacccatctctgggctccgaggctgaggacgaggctgattatactgcagctcatatacaagtggaactactttactattcggcgcgaagggaccaagctgaccgtcttaggtcagcccaaggctcg

SEQ ID NO: 444213 - DNA, 410 bp, Homo sapiens
  misc_feature: NA.44.73.G07.1.454.light.2.nb
  modified_base (372)..(372): a, c, t, g, unknown or other
taggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgttgacgacgacttagcctggtaccaacagaagcctggccaggctcccagactcctcatctatgatacttctagtagggcctctggcatcccagccccgcttcagtggcaggtgggtctggggacagacttcactctcaaccatcaccagccctagagcctgaagtattttgctagtttattactgtctacaccgtaagaagtgcctcaatntcacttcgcctggaccaagtgatatacaaacgaactgt

SEQ ID NO: 444214 - DNA, 257 bp, Homo sapiens
  misc_feature: NA.44.74.G08.3.454.light.2.nb
atgataagagaggcctggaggttcctccttagctgtgggctcagaagcagagttctggggtgtctccaccatggcctggacccctctctggctcactctcctcactctttgcatagggtctgtagtttctctgggctgactcaggatctgctgtgtctgtggccttgggacagacagtcaagatcacatgccacggagacagcctcaggagggcactatgcaagctaggtaaccaacagaagccgggacacggcccc

SEQ ID NO: 444215 - DNA, 197 bp, Homo sapiens
  misc_feature: NA.44.74.G08.4.454.light.2.nb
ggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttggtgcttataactttgtctcctggtat

SEQ ID NO: 444216 - DNA, 427 bp, Homo sapiens
  misc_feature: NA.44.75.G09.1.454.light.2.nb
caggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgccagcctggagatttcgcgaacttattactgaccaaactaattattcttttttatccgttactagttttcggcctaggggaccaagctggagatcaaaggactgggtggctgcaccatctgtcttcatcttcccgccaatctgattatatacttgtt

SEQ ID NO: 444217 - DNA, 288 bp, Homo sapiens
  misc_feature: NA.44.76.G10.1.454.light.2.nb
agcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttggtgcttataactttgtctcctggtatcaacaatatccaggcagacgcccccaaatcatcatttatgatgtcagtcatccggcctcgtaggggtttctaatccgtcttctcgtcggctacc

SEQ ID NO: 444218 - DNA, 406 bp, Homo sapiens
  misc_feature: NA.44.78.H01.5.454.light.2.nb
ctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaacttgagtgataaattgcttctggtatcagcagaggccaggccagccccctatgctggtcatctttcaggataataagcggccctcagggatccctgagcgcttctctggctccaactctagggaacacggccactctgaccatcagcgccgacccagcctctggatgaggctgactattactgtcagacgtgggaaagtgacttaagttgggtgttcggcggagggaccaagctgaccgttc

SEQ ID NO: 444219 - DNA, 257 bp, Homo sapiens
  misc_feature: NA.44.8.A08.1.454.light.2.nb
agcagagttctggggtgtctccaccatggcctggacccctctctggctcactctcctcactctttgcataggttctgtggtttcttctgagctgactcaggaccctactgtgtctgtggccttgggacagacagtccggatcacatgccacggagtcagcctcagatactatcatgcaacctggtaccagcagaagccggaacggcccctttagtgtcatctataggtaaataaccggcctagggactccgagaccg

SEQ ID NO: 444220 - DNA, 244 bp, Homo sapiens
  misc_feature: NA.44.8.A08.2.454.light.2.nb
agcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgagctcaacttcttaatgtcgcctcctgtatcaacaacactcccggaccaaacccccaactctagattcatacgaaatctact

SEQ ID NO: 444221 - DNA, 332 bp, Homo sapiens
  misc_feature: NA.44.83.H06.1.454.light.2.nb
ctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggcagtcagggcattagcaattattagcctggtatcagcagaaaccagggaaagctcctaagctcctgatctatgaaactatcctattttcgactaatcaggggtcccatctcggttcagcggcagtggatctgggacagattcactctcaccgtcagcagcctgcagcctgaagatg

SEQ ID NO: 444222 - DNA, 311 bp, Homo sapiens
  misc_feature: NA.44.86.H09.3.454.light.2.nb
  modified_base (238)..(238): a, c, t, g, unknown or other
ctgtggtagagaagacaggattcaggacaatctccagcatggccggcttccctctcctcctcaccctcctcactcactgtgcagggtcctgggcccagtctgtgctgactcagccatcctcagcgtctcgggacccccggcagacggtcacgattcttttgtctggaagtaggtccaacatcggaataattacgtatactggtatcggcaattcacaggagcggtccccagacccctnatcataggagaatcagccggccctcgacggggtccctgaccgtattccctctgcctccaagtctggccacctc

SEQ ID NO: 444223 - DNA, 220 bp, Homo sapiens
  misc_feature: NA.44.86.H09.5.454.light.2.nb
  modified_base (197)..(197): a, c, t, g, unknown or other
  modified_base (199)..(199): a, c, t, g, unknown or other
aggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggacctgtcacagtgtcatttcccatgctcaacagancngccaacgccccagacataatt

SEQ ID NO: 444224 - DNA, 298 bp, Homo sapiens
  misc_feature: NA.44.87.H10.1.454.light.2.nb
aggacttctcagttcatcttctcaccatgaggctccctgctcagctcctggggctgctaatgctctggatccctggatccagtgcggatattgtgatgtcccagactccactctctctgtcagtccacccctggacagccgcctccatctcctgcaagtccagtcagacgcctctacttggtgatggaaactgtctatttgtactggtacctgcaggaggcaggccagtcctaccacggctacctaatgtatgaggcttccgagacgggtctcgtggagtcgccagatagattcgagt

SEQ ID NO: 444225 - DNA, 440 bp, Homo sapiens
  misc_feature: NA.45.15.B04.1.454.light.2.nb
ggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggcccaatagtaagaactacttagcttggtaccagcagaagccagggcagcctctagcctgctctttacggcctctacccgggagtcccggggtccctgaccgattccagtggcagcggtctggggcagatttcactctcaccatcagcagcctgcagcctgaagatgtcgctagtttactactgtcagcaatattatgagtattcctctctacgtttcggcggaacgggaacccaaagggttcgacgaatacaaaacgactagtcggc

SEQ ID NO: 444226 - DNA, 363 bp, Homo sapiens
  misc_feature: NA.45.30.C08.1.454.light.2.nb
  modified_base (139)..(139): a, c, t, g, unknown or other
  modified_base (200)..(200): a, c, t, g, unknown or other
  modified_base (227)..(227): a, c, t, g, unknown or other
  modified_base (245)..(245): a, c, t, g, unknown or other
  modified_base (269)..(269): a, c, t, g, unknown or other
ctgctcagttaggacccagagggaaccatggaagcccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggcaggctccgaggctccnatccatgatgcatccaanagggtccctggccgtcccagaccnggttccgtggccaggtgggtctggggacagagttccacttctcacccgtcagcaacgcctggacgcctgatgtattttgctagtttacttctgt

SEQ ID NO: 444227 - DNA, 374 bp, Homo sapiens
  misc_feature: NA.45.34.D01.2.454.light.2.nb
  modified_base (162)..(162): a, c, t, g, unknown or other
cagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggganaagtcaggatattagaaatgagttaggctggtatcagcagagaccgaggggacccccccaatcctagtctatggtgcttccaggttacaaagtgggtcccatcaaggttcagtggcggtgggtctggcacagaattcactctcaccatcagccgctgcacgcccgaagtatttgactaactttattactgtactaacaagtactttcaaact

SEQ ID NO: 444228 - DNA, 360 bp, Homo sapiens
  misc_feature: NA.45.35.D02.1.454.light.2.nb
  modified_base (137)..(137): a, c, t, g, unknown or other
tgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccacgtggcatcccagccaggttcagtggcggtgggttgcacgagacttcactctcacaatcagcagcctaccaacctagaagtattttgctagtctattactggttacaac

SEQ ID NO: 444229 - DNA, 428 bp, Homo sapiens
  misc_feature: NA.45.36.D03.3.454.light.2.nb
tgctcagttaggacccagagggaaccatggaagccccagctcagcttctcttcctcctgctactctggctcccagataccaccggaaaaattgtgttgacacagtctccaggcaccctgtctctgtctccaggggaacagccaccctctcctgcgagggccagtaggagtgtcagtaagtacttaggctaggtaaccaacagaaacctggaccaggcctcccaggctcctcatccatgatgcatccaacacgggtccctggccgtcccagaccaggttccgtggcccaggtgggtctggggacaggagttcactctcaccgtcagcagcctggagcctgatgtatttgctagtttacttctgtcagcagtcgttccgccacgccgctcactttcgggcgggggtaccaggggtggagagtgagacgaa

SEQ ID NO: 444230 - DNA, 423 bp, Homo sapiens
  misc_feature: NA.45.37.D04.3.454.light.2.nb
  modified_base (247)..(247): a, c, t, g, unknown or other
  modified_base (293)..(293): a, c, t, g, unknown or other
acaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactactagcttggtaccagcagaaaccaggtcagcctcctaagctgctcatttacngggcatctacccgggaatccggggtcccctgaccgattcagtggcngcgggtctgggacagatttcactctcaccatcagcagcctgcaggctagaagatgtggctagtttatgctgtcagcaatattattatacttcctcgtactttcggcctgggaccaaagtgaatagtacaa

SEQ ID NO: 444231 - DNA, 466 bp, Homo sapiens
  misc_feature: NA.45.38.D05.1.454.light.2.nb
agaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagttttagtttgtctctggtaccaacaacaccccggcaacgcccccaaataatcatttaaggacactaagcggccctgggggtttcaagtcgcttctctggctccaagtcctggcaacacggcctccctgacaatctctgggctcaggctcgaggacgaggctgattatttctgttgctcatatgcagggaccagcacgttgggtgttcggcggagggaccagggttcgaccgtccgtaggtcacgcccaaggctcgccccctggtcactctcgttcccgcctcctctc

SEQ ID NO: 444232 - DNA, 283 bp, Homo sapiens
  misc_feature: NA.45.38.D05.2.454.light.2.nb
agaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggagttataaccttgtctcctggtaccaacagcaccaggcaaacgcccccaaatcatgatttatgaggcagtaagcgcctcgaggggtttctaatcgccttctctggctc

SEQ ID NO: 444233 - DNA, 313 bp, Homo sapiens
  misc_feature: NA.45.42.D09.2.454.light.2.nb
gctcagttaggacccagacggaaccatggaagccccagcgcagcttctcttcctcctgctactctggctcccagattccacgggagaaatagtgatgacgcagtctccagccacctgtctgtgtctccgaggggaaagtccaccctctcctgcagggccagccagagtgtcagcagcgacttagcctggtaccagcagaaacctggccaggctcccgaggcctcctcatctatggtcgtccttccgtccgagggcccacgtggtactcccagccaggttcagtggcaggtgggtctgggaacaggtcgtttac

SEQ ID NO: 444234 - DNA, 464 bp, Homo sapiens
  misc_feature: NA.45.5.A05.1.454.light.2.nb
ggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagtacttatttgtactggtacctgcagaggccaggccagtcgccgcagctcctagtccagcaggcttccagcccggttccctggagtgtcagacaggttcagtggacacggatcagacacatctttcactctagaaaatcagccgtgtggccgctgaggattgttggggtgtttattactgcatgcaagctgtagaccgtacacgtttgggccgggggacaggctggaggtcaatcgaactgtggctgcaccatctgtcttcatcttccgctatctgatcgatcgc

SEQ ID NO: 444235 - DNA, 353 bp, Homo sapiens
  misc_feature: NA.45.51.E07.2.454.light.2.nb
  modified_base (141)..(141): a, c, t, g, unknown or other
  modified_base (297)..(297): a, c, t, g, unknown or other
ctgctcagttaggacccagacggaaccatggaagccccagcgcagcttctcttcctcctgctactgtggctcccagatacctctggagaaatagtgatgacgcagtctccagccaccctgtctctgtctccgagggggaanagccaccttctcctgtagggccagtcagactattaccagcaacttagcctggtatcagacaaaacctggccaggcctccccggctcctcatctctggtgcacacaccagggccactggtactcccagccaggttcagtggcagtgggtctgggacnggggttcctctcaccatcgacgggctacgagtctgaagtatttgctagtttattac

SEQ ID NO: 444236 - DNA, 378 bp, Homo sapiens
  misc_feature: NA.45.53.E09.2.454.light.2.nb
gactcctcagttcaccttctcacaatgaggctccctgctcagctcctggggctgctaatgctctgggtctctggttccagtggggatattgtgatgactcagtctccactctccctgtccgtcaccctggagagccggcctccatctcctgcagggctagtcagacgcctcctgcatagtaatggatacaactatgtggattggttcctgcagaagccagggcagtctccacagctcctgatctatcgtggatcctattcggcccctcgggggtccctgacggttcaggtggcagtgtcaggcacagatttacactgaaaatcagcagagtggaggcgtagggaggtagttggtttaggggtttattacgtgactagt

SEQ ID NO: 444237 - DNA, 412 bp, Homo sapiens
  misc_feature: NA.45.57.F02.1.454.light.2.nb
gctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaaccaacagaagccgggacaggcccctctacttgtcatgtttaggtaaaaacgccggccctccgggatcccagaccgattctctggctccacctcaggaaacacagcttcctgaccatcactgggactcaggcgaagatgaggctgactattatgcagcatccgggacaccaataatggttatgtttcgcgccggacaaggtcaccgtctggtcacgccc

SEQ ID NO: 444238 - DNA, 398 bp, Homo sapiens
  misc_feature: NA.45.58.F03.1.454.light.2.nb
gctcagttaggacccagacggaaccatggaggccccagcgcggcttctcttcctcctgctactctggctcccagataccactggagaaatagtgatgacgcagtctccagtcaccctgtctgtgtctccgaggggaacggccaccctctcctgcagggccagtcagtatgttagcaccaacttagcctggtaccaacagagacctgcccaggcctcccaaactcctcatctctggtgtatctaccagggccactggtgtcccagacaggttcaagggcagtgggtctggggacagagttcactctcaccatcagcggcctgcagtctgaagtatttggactttattactgtcagcagtataatcactggccgtacacgtttggccggggtaccaagct

SEQ ID NO: 444239 - DNA, 366 bp, Homo sapiens
  misc_feature: NA.45.62.F07.1.454.light.2.nb
ggaactgaggagcaggtgggggcacttctccctctaacactctcccctgttgaagctctttgtgacgggcgagtcaggccattggtttttagtgtggtttcagcagaaaccagggaaagtccctaagcgtctgatctttgctacacccagtttccaaggtgggtcccatcaagattcagcggcactggatctgggacagaattcactctcactatcagcagcctgcagcctgaagattttgcgtactttattattgtctacaccataatagttatccgtgggcgttcggccaagggaccaaggtggaaatcaaaacgactgtgctgcaccatctgtcttcatcttcccgcatctgatcgatcgcgt

SEQ ID NO: 444240 - DNA, 222 bp, Homo sapiens
  misc_feature: NA.45.63.F08.2.454.light.2.nb
aggacacagcatggacatgagggtccccgctcagctcctggggctcctgctgctctggttcccaggtgccaggtgtgacatccagatgacccagtctccatctgccatgtctgcatctgtaggagacacagtcaccatcacttgtcgggcgagtcgagggcattagctaattattagcctggttcagacaagaaaccgagggaaacgtccctaagcgcctga

SEQ ID NO: 444241 - DNA, 283 bp, Homo sapiens
  misc_feature: NA.45.66.F11.1.454.light.2.nb
  modified_base (230)..(230): a, c, t, g, unknown or other
tctcgggacgtctccaccatggcctgggctctggtgctcctcactctcctcactcaggacacagggtcctgggcccagtctgccctgactcagcctgcctccgtgtctgggtctcctggacagtcgatcaccatctcctgcactggagccggcactgacgttgggagttttgaccttgtctcttggtaccaacagcaacacccaggcaaagccccaaactcttgatttangaggtcactaagcgcctcaggggtctctaatcgcttctctcgcctcaagtcgg

SEQ ID NO: 444242 - DNA, 326 bp, Homo sapiens
  misc_feature: NA.45.70.G04.1.454.light.2.nb
gaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctctggtaccaacaacaccaggacaaacgccccaaactcatgatttatgatgtcagtaatcggccctcgtaggggtttctgatcgcttctcctggctccaagtctggcacacggcctccctgaccatctctggctcc

SEQ ID NO: 444243 - DNA, 390 bp, Homo sapiens
  misc_feature: NA.45.72.G06.2.454.light.2.nb
actgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctcccagacctcctcatttatggttcttctaccgagggccctggtactcccagcccaggttcagtgccaggtgggtcctggggacagagttcactctcaccatcagcagcctgcagtctgaagtatttgctagtttatttctgtcagcagtatctataactggctgtactagttt

SEQ ID NO: 444244 - DNA, 369 bp, Homo sapiens
  misc_feature: NA.45.73.G07.1.454.light.2.nb
caggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggaaattttttgctggtatcagcagagaccagggacagcccctaggctcttgatttattctgcgtcctctgttcaagttggagtctcctcaagattcagcggcagcggctcgtgggacacatttcactctcaccatcgacagcctgcagcccgaagactttaggacgtactactgtcagcaatatacgtaaatatccgtaggacg

SEQ ID NO: 444245 - DNA, 448 bp, Homo sapiens
  misc_feature: NA.45.75.G09.1.454.light.2.nb
cagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacaccaggcaaagcccccaaatcatcatttatgatgtacaataatcggccctcgaggggtttctcatcgcttctcctggctccaagtctggcaatacggcctccctgaccatctctgggctccaggctgaagacgaggctgattatactgcaggcacatatattagtgtttccacgtcgggtattcggcggagggaaccaagttgaccgttcgtaggtcagcccaaggctgcccctggtcactcttcgt

SEQ ID NO: 444246 - DNA, 416 bp, Homo sapiens
  misc_feature: NA.45.78.H01.2.454.light.2.nb
cccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtccatcaaggttcagccggcagtggatctgggacagattcactctcacatcagcagcctgcagcctgatgtatttgactaacttattactgaccaacagtatgattagttattcgacgttcggaccgtaaagggaccaaagggtaggaaaatacgaaaacg

SEQ ID NO: 444247 - DNA, 352 bp, Homo sapiens
  misc_feature: NA.45.78.H01.3.454.light.2.nb
tcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggttacaacagaggccaggccaatcctccaaggcgtaacctaaatttataaggtttctaaccgggactcgtggggtcccagacagattcagcggcagtggtcaggcactgatttcacactagaaaattgagggtgagctgaggatgttggagttta

SEQ ID NO: 444248 - DNA, 449 bp, Homo sapiens
  misc_feature: NA.45.79.H02.1.454.light.2.nb
agaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaatcatgatttatgaggcagtaagcggccctcgtaggggtttctaatcgcttcctctggctccaagtctggcaacacggcctccctgacaatctctgggctccaggctgaggacgaggctgattattactgctgctcatatgcaggtagtagttactttggtgttcggcggtaggaccaagctagaccgtctaggtcaagcccaaggctcgcccctcggctaccg

SEQ ID NO: 444249 - DNA, 329 bp, Homo sapiens
  misc_feature: NA.45.83.H06.2.454.light.2.nb
  modified_base (246)..(246): a, c, t, g, unknown or other
  modified_base (315)..(315): a, c, t, g, unknown or other
taggacccagagggaaccatggaaaccccagcgcagcttctcttcctcctgctactctggctcccagaaagtactggagagagtgtgttgacgcagtctccaggcaccctctctttgtctccaggggaaagagcaaccctctcctgcaggaccaccagagtgttaggagcaatcacttagcctggtaccagcagaaacctggccaggctccaaagctcctcatctacggtgcatccagtagggccntggcatcccagacaggttcagtggccaggtgggtctgggacaagacttcactctcacatcacaagtganctagagtatttgct

SEQ ID NO: 444250 - DNA, 335 bp, Homo sapiens
  misc_feature: NA.45.84.H07.2.454.light.2.nb
tttctcgtagtctgctttgctcagcgtcagggtgctgctctggctcccaggtgccaaatgtgacatccagatgacccaatctccttctaccctgtctgcatctgtaggagacagagtcaccatcacttgccgggccagtcaaagtattagtgactggttggcctggtatcagcagaaaccggggaagcccctaaggtcctgatctacagggcgtctagtctagaaagtggggtccaccgaaggttcagcggcagtggatcgtgggacagaacttcactctcaccatcagcagcctgcagcctgatgatttgctaacttacttctgaccaagaact

SEQ ID NO: 444251 - DNA, 423 bp, Homo sapiens
  misc_feature: NA.45.86.H09.1.454.light.2.nb
gactcctcagttcaccttctcacaatgaggctccctgctcagctcctggggctgctaatgctctgggtctctggatcctttggggatattgtgatgactcagtctccactctccctgcccgtcacccctggagagccggcctccatctcctgcaggtctagtcagagcctctgaatactaatggatacaactattggattggtatctgcagaagccagggcagtctcctcagctcctgatctagtttgggtctgatcgggccctcccggggtcctgactaggttcagtggcagtggatcgaggcacagtatttacactgagaatcagcgaagtggagacgtgaggatggttggtcgtttatactgctatgactaaggtttagtcactccttatactttggcctaggggaccaggctggagaat

SEQ ID NO: 444252 - DNA, 417 bp, Homo sapiens
  misc_feature: NA.45.87.H10.1.454.light.2.nb
gctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaaccaacaaaacctggccaggctcccaggctcatcatctatgacgcatcgaacagggccactggcatccccagccaggttcagtggcaggtggtcctgggacagacttcactctcaccatcagcagcctggaccctgagtatttgcctatttactactgtcagcagcgtggcgacgagcgctcactttcggcggagggaccgaaggtggagaacgtacgaaaacga

SEQ ID NO: 444253 - DNA, 263 bp, Homo sapiens
  misc_feature: NA.4.14.B03.1.454.light.2.nb
actcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccggcagtcagagcattagtggctggctggcctggtatcagcaagaaaccgagggagacgcccctaagctcttgatctttgatgccactaatttggaaacgtggggtacca

SEQ ID NO: 444254 - DNA, 210 bp, Homo sapiens
  misc_feature: NA.4.21.B10.2.454.light.2.nb
  modified_base (181)..(181): a, c, t, g, unknown or other
tcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaaccaaaaaatntgtacttattcggtaaccagacagaagtc

SEQ ID NO: 444255 - DNA, 327 bp, Homo sapiens
  misc_feature: NA.4.26.C04.2.454.light.2.nb
actcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatcttagtttgggtctaacgtcgggcctccggggtcctgacaggttcagtgcagtggatcgagcacagtatttacactagaaaatcag

SEQ ID NO: 444256 - DNA, 376 bp, Homo sapiens
  misc_feature: NA.4.27.C05.1.454.light.2.nb
caggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtccccttttagcatgtatcggatagaagcggccctagagggactccctgacgccgtcttctctggactccaactcgtgggaaacacgagccactctcgaccatcagcggaccctaactttagatgagccgactatttctgtcacacgtgggacagtggcgactgcga

SEQ ID NO: 444257 - DNA, 445 bp, Homo sapiens
  misc_feature: NA.4.33.C11.1.454.light.2.nb
caacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgcaagtccagccagagtgttatatacagctaccaacaatgagaactacttagcttggtatcagcaagaaaccaggacagcctacctaagctgctcatttaccgggcagctacccccgggaatccggggtccctgacgcgattcagtggcagcgggtctgggacagatttcactctcaccatcagcagcctgcaggctagaagatgtggctagtttattactgtcagcaatattctactactcctacggtactttcggcggacgggaaccgaaggtaggagatacgaaacga

SEQ ID NO: 444258 - DNA, 344 bp, Homo sapiens
  misc_feature: NA.4.35.D02.2.454.light.2.nb
  modified_base (307)..(307): a, c, t, g, unknown or other
agtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtggaccaaggtcacccgtctaggtcagcccaaggcccacccntgtcactctcgttccccaccctcctcctacagtcgct

SEQ ID NO: 444259 - DNA, 448 bp, Homo sapiens
  misc_feature: NA.4.39.D06.2.454.light.2.nb
ctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagacaaacgcccccaaattcataattatgagtcactaagcggccctcaggggtccctgatcgcttcctctgcctccaaggctggcaacacggcctccctgaccgtctctgggctccaggctgaggatgaggctgattattattgcagctcatatgcaggcagttacaatgtgatagttcggacggagggaccaaacgtcgaccgtcctaaggtcagcccaaggctcgcccctc

SEQ ID NO: 444260 - DNA, 246 bp, Homo sapiens
  misc_feature: NA.4.40.D07.1.454.light.2.nb
actgctcagttaggacccagagggaaccatggaagccccagctcagcttctcttcctcctgctactctggctcccagataccaccggagaaactgtgttgacacagtctccagccaccctgtctttgtctccgaggggaaagccatcctctcctgcagggccagtcagagtgttagcagctacttaggctggtaaccaagaaacctggccaggcctcccaggcctcctcatctatgatgcatccaa

SEQ ID NO: 444261 - DNA, 300 bp, Homo sapiens
  misc_feature: NA.4.50.E06.1.454.light.2.nb
tcagactcagtcaggacacagcatggacatgagggtccccgctcagctcctggggctcctgctgctctggctcccaggtgccaactgtgacatccagatgacccagtctccttccaccctgtctgcatctgtaggagacagagtcaccttcacttgccgggccagtcagactgtagtcaccattggcctggtatcagcagaaccaggcaaacgccccagaactctgatctttgatcgcctctactttggacgagtggggtcccatcaaggttcagcggcagtcggatctgagacagtaaa

SEQ ID NO: 444262 - DNA, 202 bp, Homo sapiens
  misc_feature: NA.4.52.E08.1.454.light.2.nb
acccagtcaggacacagcatggacatggagggtccccgctcagctccgtggggctcctgctgctctggttcccaggttccagatgcgacatccagatgacccagtctccatcttccgtgtctgcatctgtaggagacagagtcaccatcacgttggcgggcgagtcgagggttattagcaaggtggttggctggtatcagac

SEQ ID NO: 444263 - DNA, 409 bp, Homo sapiens
  misc_feature: NA.4.59.F04.2.454.light.2.nb
tcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagaataaattgggaccataaatttgcttctggtatcagcagaagccaggccacgtcccctatactggtcatctatcaagataccaagcggccctcagggactccctgacgcgattctctggctccaattctagggaacacagccactctgaccatccaccgggacccaggctgtagatgaggctgactattactgtcaggcgtgggacagcagcacgtgaggtgttcggcggagggaccaagctgaaccgt

SEQ ID NO: 444264 - DNA, 295 bp, Homo sapiens
  misc_feature: NA.4.67.G01.2.454.light.2.nb
tcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggcccaaccccatgtcactctcgttccccgccccctcctcctacagtgct

SEQ ID NO: 444265 - DNA, 393 bp, Homo sapiens
  misc_feature: NA.4.72.G06.1.454.light.2.nb
ctgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggaccaagctcccaggctgctcatctataatacaatcaacaagggactagttggtcgtcccagacaggttcagcggcaggtgggtctggggacagagttcactctcactatcagcagcctgctactttgaagtatttgctagtctatctattgtcagcagtataagttggtgcctcggacgttcgg

SEQ ID NO: 444266 - DNA, 416 bp, Homo sapiens
  misc_feature: NA.4.74.G08.1.454.light.2.nb
cactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaacccctaaagctcctgatctacgctgcgtctagtttacagagtggacgtcccccatcaaggttcagcggcaggtggatctggcacagatttcactctcaccatcagcagcctgcagcctgaggtattttgactaacttattactgtactaacaagtattacacttacccgtggtacgttcggaccgaaagggacctaagggtacggaaa

SEQ ID NO: 444267 - DNA, 410 bp, Homo sapiens
  misc_feature: NA.4.75.G09.1.454.light.2.nb
cagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttggggataagtatgttgtggtatcagcagaagccaggccagtcccctgtgctggtcatctattatgataccaagcggccctcgagggactcccgtgacgcgattctctggctccaactcgtgggaacacagccactctgaccatcagccgggacccaggctagtggatgaggctgactattactgtcaggcgtgggacagcagcactccctatcgtcttcggcacgtgggaaccaggtcaccgtctaggtc

SEQ ID NO: 444268 - DNA, 340 bp, Homo sapiens
  misc_feature: NA.4.75.G09.2.454.light.2.nb
cagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaagttggggataagtatgttgtttgttggtatcagcagaagccaggccagtcccctgtgctggtcatctattatgataccaagccggcctcgagggactccctgagcgtattctctggcctccaactcgtagggaacacgacgccactctacgaccatcgacggccgggacccagggcctagtgg

SEQ ID NO: 444269 - DNA, 383 bp, Homo sapiens
  misc_feature: NA.4.82.H05.1.454.light.2.nb
cccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcaagtggtggctggtatcagcagaaaccagggaaacgcccctaaactcctgatctatgaagcatccagtttgacaaagtggggtcccatcaaggttcagcggcagtggatcgtgggacagatttcactctcaccatcagcagcctgcagcctgaagtattttgactaacttactactgtacaaacgtacggtacttaaactacgttttaccc

SEQ ID NO: 444270 - DNA, 252 bp, Homo sapiens
  misc_feature: NA.51.12.B01.2.454.light.2.nb
aggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagacgccggcaggccctgtgttggtgatgtaataaagacactgagaggccctgagggatcc

SEQ ID NO: 444271 - DNA, 445 bp, Homo sapiens
  misc_feature: NA.51.19.B08.1.454.light.2.nb
agcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaacgccccaaagtcattatttatgagccagtaggcgagcctcagggatttctagtcgccttctctgcctcgcgtctggcaacacggcctccctgacaatttctgggctcagcctgaggacgagtctcactactactgctcctcatatgcagacaattagttcctggtgttcggcggagggaccaagttcgaccgtcctaggtcagcccgaaggctcgccccctcggtcacgttcc

SEQ ID NO: 444272 - DNA, 422 bp, Homo sapiens
  misc_feature: NA.51.2.A02.1.454.light.2.nb
cagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtagggggaaacaacattggaaagtaaaactgtgcactggtaccagcagaagccaggccaggcccctgtgctggtcgtctatgatgatgccgaccggccctcgagggactccccgtgaacgtatttcctcgtggctcccagctctgagaacacggccaccctgacgcatcagcagggtcgaaggccggggatggaggccgactattactgtcaggtgtgggatacgtagtagtgatcatgtcttcggactgggaccaaggtcaccgtcaggtcacgccc

SEQ ID NO: 444273 - DNA, 451 bp, Homo sapiens
  misc_feature: NA.51.23.C01.1.454.light.2.nb
gctcagttaggacccagagggaaccatggaagccccagctcagcttctcttcctcctgctactctggctcccagataccatcggggaaactgtgttgacacagtctccagccaccctgtctttgtctccaggggaaagagccacctctcctgcagggccagtgagagtattgacatcttcttggcctggtaccaacagaaacctggccaggctccccgactcctcatttatgatgcataccaaaagggtcgttggcatcccagccaggttcagtgcagtgggtcctgggacagaatcactctcacatcaccagactagagcctgaagtatttgctagtttattactgtcagcagacgtaacaacgtggctctcgtttcggcggtagggaccaaggtggagatacaaaacgaactgtaggctgcaccatctgtcttcatccttccgcactct

SEQ ID NO: 444274 - DNA, 462 bp, Homo sapiens
  misc_feature: NA.51.26.C04.1.454.light.2.nb
caggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgagtttcggcggagggaccagtctgaccgtcctaggtcagcccaaggctgccccctcggtcactctgttcccgccctcctctcgtagccact

SEQ ID NO: 444275 - DNA, 460 bp, Homo sapiens
  misc_feature: NA.51.27.C05.1.454.light.2.nb
  modified_base (302)..(302): a, c, t, g, unknown or other
ctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccaccaggacaaacgcccccaaatcatgatttatgatgtcagtgatcggccctgaggggtttcaatcgcttctctggctccaagtccggcaacncggcctccctgaccatctctgggctccgaggccgaggacgaggctgattatactgcacctcatatacaagcagcaacaagttgggtagttcggcggagggaccaagctgaccgtcaggtcacgcccaaggctcgccccctggtcactctcgttccccg

SEQ ID NO: 444276 - DNA, 338 bp, Homo sapiens
  misc_feature: NA.51.27.C05.2.454.light.2.nb
gaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtcccctgtcgtggtcatctatcaagacaccaagccggccctcgagggactccctgagcgattcctctggctccaactcgtagggacacacgcccactctcgaccatcagcgggacgcaggctgtggatgga

SEQ ID NO: 444277 - DNA, 438 bp, Homo sapiens
  misc_feature: NA.51.28.C06.1.454.light.2.nb
caggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgacgcgattctctggctccactctgggaacacagccactctgaccatcagcgggacgcaggctgtggatgaggctgacttttactgtcaggcgtgggacagcgacactgccgtggttcgggcgggggaccaaggcgtgaccgttccgtcggtcgacgcccaacggctcgcccctcggt

SEQ ID NO: 444278 - DNA, 390 bp, Homo sapiens
  misc_feature: NA.51.29.C07.1.454.light.2.nb
ggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcacgcctgaagtatttttcaaaacttataagtgtctacatcataattcttggagagatcacacgttggaactgtggctgcaccatctgtcttcatccttcccgcatctgatcgtagcaact

SEQ ID NO: 444279 - DNA, 415 bp, Homo sapiens
  misc_feature: NA.51.3.A03.1.454.light.2.nb
cagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaagccaggccaggcccctgtcttggttattataaagactttgagaggccctcacgggacccctgagcgattctctcggctccagctcagcgacaacagtcacgttgaccatcagtgagtccaggcagaggacgaggctgactattactgtcagtcatcagacagcagtgcacttatgtcgtattcgggcggagggaaccaaacgttcgaccgttcctaagggtca

SEQ ID NO: 444280 - DNA, 371 bp, Homo sapiens
  misc_feature: NA.51.30.C08.1.454.light.2.nb
  modified_base (176)..(176): a, c, t, g, unknown or other
caggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagntatgcttattggtaccatcagaagtcaggccaggcccctgtactggtcatctatgaggacaccaaacgccctccgggatccctacgagattctctggctccagtttaggacagtggccaccctgacaatcaggtcggggcccagggtggggatggagggtgaattacactgttactcaacagacattactactac

SEQ ID NO: 444281 - DNA, 429 bp, Homo sapiens
  misc_feature: NA.51.35.D02.1.454.light.2.nb
aggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccctgtgttggtgatgtataaagacactgagaggccctcgagggatccctgagcgattcctctggctccaggtcagggcaacggtcacattggccatcagtggagtccaggcagaggacgaggctgactattattgtacaatcaacagacaccattggtacttatgtcttggaactgcgacaaggttcaccgtcttgggttcacgcccaaggcccaaccca

SEQ ID NO: 444282 - DNA, 434 bp, Homo sapiens
  misc_feature: NA.51.37.D04.2.454.light.2.nb
  modified_base (176)..(176): a, c, t, g, unknown or other
  modified_base (293)..(293): a, c, t, g, unknown or other
aggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgttntttgctttttggaccaacagaagccaggccaggcccctataataatatataataaagacagtgagaggccctaagggatccctgagcgattctctggcctccagctcagggacaacngccacgttgacgattagtggagtccaggcagaagacgagctgactatactgtcaaatcagcagacgacagtggtacttatggagtattcgggcggaagggaaccaaagggttgaccggttccgtaagggtcagccaagggc

SEQ ID NO: 444283 - DNA, 436 bp, Homo sapiens
  misc_feature: NA.51.38.D05.2.454.light.2.nb
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggttttataactatgtctcctggtaccagcaccaccaggcaaacgcccccaaatcatgatttatgatgtcagtgatcggcctgaggggtttcaatcgcttctctggctccaagtccggcaacacggcctccctgaccatctctggccctccgaggccgaggacgaggctgattatactgcagctcatatacaatacaaataacaagttgggtagttcggacggagggaccaaacgtcgaccgtcctaggtcacgacca

SEQ ID NO: 444284 - DNA, 428 bp, Homo sapiens
  misc_feature: NA.51.39.D06.1.454.light.2.nb
gtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgtgatatataaagacagtgagaggccttcgagggatccctgagccgattctctggctccacctcagggacacgtggtcacattgaccatcagtgagtccagcagaagacgaggctgactattctgtcaatcttacagactcaagtgtacttatgtcttcggaactt

SEQ ID NO: 444285 - DNA, 395 bp, Homo sapiens
  misc_feature: NA.51.40.D07.1.454.light.2.nb
agtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactattaaatggtatcagcagaaaccagggcaagcccctaaactcctgatctacgatgcatccaattggaaacaggggtcccatcaaggttcagtggagtggtctgggacagtatttacttcaccatcagcagccttcaccctgaagatcttgacaacatattactgtacaacagtatgataatctcccactcgactttcggacggagggaccaaggt

SEQ ID NO: 444286 - DNA, 429 bp, Homo sapiens
  misc_feature: NA.51.41.D08.1.454.light.2.nb
  modified_base (420)..(420): a, c, t, g, unknown or other
cttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaacccccctaaatcctgatctatgctgcatccagtttgacaaagtgaggtcccatccaggttcagtggcagtggatctgggacaagatttcactctcaccatcagtagtctgacaacctgaagtattttgactaaacttactactgtacaaacagtacggttacggtaccctgctcacttcggcggagggaccaaggtaggagataacaaacgactgttggcgtgcncatctgtct

SEQ ID NO: 444287 - DNA, 392 bp, Homo sapiens
  misc_feature: NA.51.47.E03.1.454.light.2.nb
  modified_base (159)..(159): a, c, t, g, unknown or other
caggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctgganacagattgactgaataaatatgctggctggtatcggcagaagccaggccagtcccctgtgttggtcatctatcaggataccaagccggcctcgacgggactcccgtgacgcgtattctctggctccaaactcgtacgggaacacagccactctgaccatcagcgggactcgaggctatcgatgaggctgactatactgtcaggcgtgggacagccgcacgtggggtactcggg

SEQ ID NO: 444288 - DNA, 450 bp, Homo sapiens
  misc_feature: NA.51.5.A05.1.454.light.2.nb
  modified_base (436)..(436): a, c, t, g, unknown or other
aggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggcccctgtattggtcatctatgaggacaccaagcgaccctccggaatccctgagagagtcgctggctcgaggtcagggcaatggccaccttgactatcactgggacccagatggacgatgaaggtgactacactgttatcgacaggacagcagtggtagtcgagggggtcttcgggcggagggacgaagctgaccgtctgacgtcgacgcccaaggctcgcccctcggtcnctcttcgttccccg

SEQ ID NO: 444289 - DNA, 388 bp, Homo sapiens
  misc_feature: NA.51.52.E08.1.454.light.2.nb
gtgctcgatttagtcgagctctcagagagaaagggggtaggctcaggaggcagagctctgattgtctcaccatggcctggatccctctcctgcctccccctctcattctctgcacagtctctgtggcctcctatgagctgacacagccatactcagtgtcagtgtctccgggacagacagccaggatcacctgctcaggagatgtaacgtaagggaaaaaaatgtagctcgttggttccagcagaaggcggccaggcccccctgtcttgatgatttataagacactgagcggcctcgagggactccctgagcgattctccggctccagctcgagggactacagtcacttgaccatcagcggggcccaggtgacgatgaggctgactat

SEQ ID NO: 444290 - DNA, 465 bp, Homo sapiens
  misc_feature: NA.51.53.E09.1.454.light.2.nb
caggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggacaaacgtccccaaactcatgatcttgagtcagtgatcggccgcaggggtttctcatcgcttctcccggctccaagtctggcagcacggcctccctgaccatctctgggctccgaggctgaggacgaggctgattatactgcaggctcatatacaaacagaaacacgttgggtgttcggcgggccgggaaccaaacgtcgacccgttcctacgtcacgcccaaggcctcgcccctcggtcactctcgtt

SEQ ID NO: 444291 - DNA, 367 bp, Homo sapiens
  misc_feature: NA.51.55.E11.1.454.light.2.nb
  modified_base (341)..(341): a, c, t, g, unknown or other
gaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgtatgcttatggtaccagcagaagccggcaggccctgtgtggtgatgtataaagacactgagaggccctcgagggactcccgtgagcgattctctggctcaggtcagggacacggtcacattgccatcagtgagtccaggcagagacgaggctgactattatgtcaatcaanagacacctattggtacttatgtctta

SEQ ID NO: 444292 - DNA, 300 bp, Homo sapiens
  misc_feature: NA.51.57.F02.1.454.light.2.nb
aggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggccctgtgttggtgatgtataaagacactgagaggccctgagggactccctgagcgtattcctctggctccaggtacagggaacaacgggtcac

SEQ ID NO: 444293 - DNA, 442 bp, Homo sapiens
  misc_feature: NA.51.59.F04.1.454.light.2.nb
ctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggactccctgagcgattctctggctccgaggtcagggacaacggtcacattggccatcagtggagtccaggcagaggacgaggctgactattatgtacaatcaacagacaccattggtacttatgttcttcggaactgacgaacgaaggtcaccgtcctcgggtcacgaccc

SEQ ID NO: 444294 - DNA, 467 bp, Homo sapiens
  misc_feature: NA.51.6.A06.2.454.light.2.nb
tttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactattctgtcaatcttcagacatcagtggtacttatgtcttcggaactgggaccaaggtcacgtctaggtcagcccaaggcccaacccgctgtcactctccg

SEQ ID NO: 444295 - DNA, 423 bp, Homo sapiens
  misc_feature: NA.51.60.F05.1.454.light.2.nb
  modified_base (135)..(135): a, c, t, g, unknown or other
ggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccaggccagtcccctgtggtggtcatctatcaagacaccaagcggccctcggggatacccctgagcgattctctggctccacctctgggaacacagccactctgaccatcagcgggacgcaggctgtggatggaggctgactttactgtcaggcgtgggacagcgacacgtgccgtgtcggcggagggaccaagctgaaccgtctcggtcacgcccaaggctccg

SEQ ID NO: 444296 - DNA, 471 bp, Homo sapiens
  misc_feature: NA.51.61.F06.1.454.light.2.nb
ccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttcttagcctggtatcagcaaaaaccagggaaaccccctaagctcctgatctatgctgcatccactttgacaaactggatccatcaaggttcagcggcagtggatcgtgggacagaattcactctacacatcagcagcctgcagcctgaagtttttgactaaactttattactgtacaaactagtactttaaatactttaatcccgttacggtaccgtttccgggaccgtaaacggggaacctaaaggggttacggaaaaacttccgaaaaacggtaaaccgttggttacgggacct

SEQ ID NO: 444297 - DNA, 258 bp, Homo sapiens
  misc_feature: NA.51.62.F07.1.454.light.2.nb
ctcctcagttcaccttctcacaatgaggctccctgctcagctcctggggctgctaatgctctgggtcccaggatgcactggggatgttgtggtgactcagtctcctctctccctgcccgtcacccttggacaggcgcctccatctcctgcaggtctagtcacagcctcctacacagtgatggaaacacctacttgactttggttcagcagagcctggccaatctccaagctccttattataaggtttcaagtcgggta

SEQ ID NO: 444298 - DNA, 387 bp, Homo sapiens
  misc_feature: NA.51.64.F09.1.454.light.2.nb
taggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagagcctggccaggctcccaggctcctcatctatggttcatccaccagggccctgatactcccagccaggttcagtcggcagtggtctgggacagattcactctcaccatcagcagcctgcagtctagaagtatttgctagtttattactgtcagtcagtatgatagtgcctcgtactacgtttgccgtaggggacc

SEQ ID NO: 444299 - DNA, 329 bp, Homo sapiens
  misc_feature: NA.51.66.F11.1.454.light.2.nb
ggtagagaagacaggactcaggacaatctccagcatggccagcttccctctcctcctcaccctcctcactcactgtgcagggtcctgggcccagtctgtgctgactcagccaccctcagcgtctcgggacccccggagagggtcaccatctcttgttctggaagcagctccaacatcggaagtaatgctagtaaactggtaccagcagcctcccgaggaaccgcccccaaactcctcatctacagtagtaatcagccgccctcgacggggtccctgaccccgtattcctctggcctccaagtctggccacctcacgccctccctggccc

SEQ ID NO: 444300 - DNA, 418 bp, Homo sapiens
  misc_feature: NA.51.67.G01.1.454.light.2.nb
ccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccgagggacacgacccctaaactcctgactcctcgatgcatccactttggaaacaggggtccatcaaggttcagtggaagtggctctgggacagtattttacttcaccatcagcaggctgcagcctgaagacattgacaacattattactgtacaacagtatgatagtctccgctcacgtttcgggcgggggaccaagggtcggagtcaagcgaactgtgg

SEQ ID NO: 444301 - DNA, 339 bp, Homo sapiens
  misc_feature: NA.51.67.G01.2.454.light.2.nb
ccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccgagggacacgacccctaaactcctgactcctcgatgcatcctaacgtttacggaaaaccgtacgggggtaccccaagtaccgtaaagggtttcaagggttaggggtaaaacggttgggtccgttaccggtagggggtaac

SEQ ID NO: 444302 - DNA, 406 bp, Homo sapiens
  misc_feature: NA.51.76.G10.1.454.light.2.nb
taggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggcccactgatatcccagccaggttcagtggcaggtgggtctggggacaggagttcactctcaccatcagcagcctgcagtctgaagtatttgactaatttattactgtcagcagtataataactggcctcgtactactttcggctaggggaccaagctggatatac

SEQ ID NO: 444303 - DNA, 345 bp, Homo sapiens
  misc_feature: NA.51.76.G10.3.454.light.2.nb
cagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcctgcatagtattggatacaactattggattggcacctgcagaagccagggcagtctccacaggtcctgatctatttgagttctaacgtccccgggcccccgggtctgacaggttcagtggcaggtggatcgaggcacagtatttaactagaaaatcagcagagtggaggctaggaggta

SEQ ID NO: 444304 - DNA, 462 bp, Homo sapiens
  misc_feature: NA.51.78.H01.1.454.light.2.nb
  modified_base (458)..(458): a, c, t, g, unknown or other
tgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagagaccagggaaagcccctaaactcctgatctatgatgcatccaatttggaaagtggggtcccatcaaggttcagtggcagtggatcgtgggacagatttcactctcaccatcagcagtgtgcgacctgaagattttgctaacttactactgtcaacagagttaacacgtacccctnaacg

SEQ ID NO: 444305 - DNA, 471 bp, Homo sapiens
  misc_feature: NA.51.80.H03.1.454.light.2.nb
  modified_base (283)..(283): a, c, t, g, unknown or other
tgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcacccaggcaaacgcccccaaatcatgatttangagtcagtaagcggcctcgaggggtccctgatcgccttctctggctccaagtctggcaacacggccctccctgacccgtctctgggcctccgaggctgaggatgaggctgattattactggctgctcacatgcaggcagcagtcggtgtgctagttcggcgggacgggaccgaagcctcggacccgtc

SEQ ID NO: 444306 - DNA, 416 bp, Homo sapiens
  misc_feature: NA.51.82.H05.1.454.light.2.nb
ctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacacgacccccaaactcctcatccatgactaccagaaactcccggcccgtcgggggtccctgaccgattctctggctccaagtctgacacttcacgcctcctgccatcactggctccagactgagatgaggctgactattactgccagtcctatgacagcaggctgactgctgtggtttcggcggtcgggc

SEQ ID NO: 444307 - DNA, 450 bp, Homo sapiens
  misc_feature: NA.51.86.H09.1.454.light.2.nb
cttgactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggttcagcagaggccaggccaatctccaagacgcctaatttataaggtttctaaccgggactctggggtcccagacagattcagcggcagtgggtcaggcactgatttcacactgataatcgacagggtggaggctgaggatggttgggtttattactgcatgacaaggtacacacgtggcctgggacgttcggaccgaagggaccaaggtaggaaatcgaaaacgaactgtaggc

SEQ ID NO: 444308 - DNA, 401 bp, Homo sapiens
  misc_feature: NA.52.10.A10.1.454.light.2.nb
taggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctccagctcctcatctatgatgcatccaatcgggccactggcatcccagccaggttcagtggcagtcgggtctgggacagacttcactctcaccatcagcaacctagagcctagaagtactttgactagtttatactgtcagcagcgtagtaagtgcgtcgttcggccaagggacacgactggaagttaaacgactg

SEQ ID NO: 444309 - DNA, 426 bp, Homo sapiens
  misc_feature: NA.52.12.B01.1.454.light.2.nb
gaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaagttggggataaatatgttcctggtatcagcagaagccaggccagtcccctgcgttggtcatctatcaagataccaagaggcgctcgagggatccctgacgcgattctctggctccactcgtggggacacagccactctgaccatcagcgggacccagactctggatgaggctgactattactgtcaggcgtgggacagcagcgacgggggtgtcgggcggagggaccaagctcgaccgtctaggtcaagccgaaggctcgcccct

SEQ ID NO: 444310 - DNA, 360 bp, Homo sapiens
  misc_feature: NA.52.12.B01.2.454.light.2.nb
tcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcagggcattagctagttattagcctggtatcagacaaaaaccgagggaaaccccctaagctcctgatctatggtcgctatcaactttgacgtaagggtcggggtacccagtcgaaggttcagcggcagtgatcgtgggacagatcactctcacaatcagcagcctg

SEQ ID NO: 444311 - DNA, 228 bp, Homo sapiens
  misc_feature: NA.52.13.B02.1.454.light.2.nb
aggcagcactctcgggacgtctccaccatggcctgggctctgctcctcctcagcctcctcactcagggcacaggatcctgggctcagtctgccctgactcagcctcgctcagtgtccggtctccgtggacagtcagtcaccatctcctgcactggaaccaggagtgatagttggtgtcataactatgtctctggtacagcagctccaggacaaacgcccccaaactca

SEQ ID NO: 444312 - DNA, 185 bp, Homo sapiens
  misc_feature: NA.52.14.B03.1.454.light.2.nb
taagtggttggcctggtatcagcagataccagggaaagcccctaaactcctgatctataaggcgtctagtttagaaagtgggtcccttcaaggttcagcggcagtggatctgggacagaattcactctcaccatcaacagcctgcagcctgatgattttgcaacttattactgccaaactataat

SEQ ID NO: 444313 - DNA, 342 bp, Homo sapiens
  misc_feature: NA.52.19.B08.2.454.light.2.nb
cacagcatggacatgagggtccctgctcagctcctggggctcctgctgctctggctctcaggtgtcagatgtgtcatccagatgacccagtctccttcctccctgtctgcatctataggagacagaatcaccatcacttggccgggcagtcgagacattagcatgtatctgaattggtatcagacaaaaagtagggacacgacccctaaatcctgatcctcgatgcatccactttggagacgaggggtcccatccaaggttcagtggaagtggctcgtgggactagtattttacttcaccatcagcaggctgcagcctagaagatgtgacaaacatattact

SEQ ID NO: 444314 - DNA, 380 bp, Homo sapiens
  misc_feature: NA.52.20.B09.1.454.light.2.nb
  modified_base (298)..(298): a, c, t, g, unknown or other
aggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtagttataactatgtctcctggtaccaacaccaccaggcaaacgcccccaaatcatgatttatgatatcagtgatcggccctcgaggggtttcaatcgcttctcctggctccaagtccggcaacncggcctcctgaccatctctgggcctccgaggccgaggacgaggctgattattattgcagctatataacaaacaaacaaacaa

SEQ ID NO: 444315 - DNA, 404 bp, Homo sapiens
  misc_feature: NA.52.25.C03.1.454.light.2.nb
  modified_base (237)..(237): a, c, t, g, unknown or other
tcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattagctagttattagcctggtatcagacaaaaaccgagggaaagcccctaagctcctgatctagtggtnctatctaactttgcaaggtgggtccatcaaggttcagcggcagtggatcgtgggacagaattcactctcacaatcagcagcctgcagcctagaagattttgactaaacttattactgtacaaactaccttaatacgttactccttcactttcggccctgggaccaaa

SEQ ID NO: 444316 - DNA, 362 bp, Homo sapiens
  misc_feature: NA.52.25.C03.2.454.light.2.nb
  modified_base (237)..(237): a, c, t, g, unknown or other
tcccagtcaggacacagcatggacatgagggtccccgctcagctcctggggctcctgctgctctggctcccaggtgccagatgtgacatccagttgacccagtctccatccttcctgtctgcatctgtaggagacagtgtcaccatcacttgccgggcagtcagggcattagctagttattagcctggtatcagacaaaaaccgagggaaagcccctaagctcctgatctagtggtnctatcaactttgacgtaagggtcgggtacccagtcgaaacgggttcaggcgcagtggatcgtgggacagtaattcactctacacaatcagcagcctagcagtcctagaagtattttgaccttaaa

SEQ ID NO: 444317 - DNA, 279 bp, Homo sapiens
  misc_feature: NA.52.26.C04.2.454.light.2.nb
caggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaaataaatttgcttgctggtatcaccagaagccaggccacgtcccctgtcctggtcatctatcaagatgtcaagccggccctcgagggacctcccgtgacgcgtattcc

SEQ ID NO: 444318 - DNA, 416 bp, Homo sapiens
  misc_feature: NA.52.30.C08.1.454.light.2.nb
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaatgactattggtgttataattatgtctctggtaccaacaccaccaggcaaacgcccccaaatcattattatggtgtcggtgaccggccctgaggggtttcgaatcacttctctggctcccaagtccggacaacacggcctccctgaccatctctgggctccgaggccgaggacgaggctgattatactgcgctcatataacaaaacaacaaactaagtttggggtagttcgggacggaagggaccaag

SEQ ID NO: 444319 - DNA, 392 bp, Homo sapiens
  misc_feature: NA.52.33.C11.1.454.light.2.nb
ctagctgtgctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaacgcccggcacggcccctgtcttgcttatttataaagtactttgagacggccctcgacgggacccctgacgcgattctcctggctccagctcagcgacaacagtcacgttgaccatcagtgagtccaggcagaggacgaggctgactattactgcagtcatcagacagcagtgact

SEQ ID NO: 444320 - DNA, 437 bp, Homo sapiens
  misc_feature: NA.52.33.C11.3.454.light.2.nb
tgctcagttaggacccagagggaaccatggaagccccagctcagcttctcttcctcctgctactctggctcccagataccaccggagaagttgtattgacacagtctccagccaccctgtctttgtctccgaggggggaagccaccctctcctgcagggccagtcagagtgttggcaacctcttagcctggtaccaacaaaacctggccaggctcccaggctcctcatctatgatgcatccacgagggccactggcactcccagccaggttcagtggcaggtgggtctgagacagacttcactctcaccatcagtcggcctcgagcctgaagtattttgctagtttattactgtcagcagcgtagccactggctctctttcggcgagggaccaaggttcgagatacaaacgaactgtggctgcaaccatctgtcttc

SEQ ID NO: 444321 - DNA, 306 bp, Homo sapiens
  misc_feature: NA.52.34.D01.2.454.light.2.nb
  modified_base (176)..(176): a, c, t, g, unknown or other
tccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggccaggcccctgtgttggtgatgtaataaagacactgagacggccctacgagggactccctgacgccgattctctggctccgaggtcgagggacaacggtcac

SEQ ID NO: 444322 - DNA, 355 bp, Homo sapiens
  misc_feature: NA.52.35.D02.1.454.light.2.nb
caggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggacaaacgcccccaaactcatcattttgagtcactaagcgcctcgagggtccctgatcgcttctctggctcgaagtctggcacacggcctccctgaccgtctctcgggctccgaggctgaggatgaggctgattacactg

SEQ ID NO: 444323 - DNA, 299 bp, Homo sapiens
  misc_feature: NA.52.35.D02.2.454.light.2.nb
  modified_base (137)..(137): a, c, t, g, unknown or other
gctcagttaggacccagagggaaccatggaaaccccagcgcagcttctcttcctcctgctactctggctcccagatatcaccggagaaattgtgttgacgcagtctccaggcaccctgtctctgtctccgagggganagacgcccaccctctcctgcaggaccagtcagagtattagcaactagttactagcctggtaccagcagactcctggccaggctcccaggctcctcatctatggtgcgtcagcagggccagtggcatcccagaccaggttcagtggcaggtgggtctgggaca

SEQ ID NO: 444324 - DNA, 323 bp, Homo sapiens
  misc_feature: NA.52.36.D03.1.454.light.2.nb
caggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggtaaaattatgctgactggtaccagcagaagccaggccaagcccctgagttggtgatataacgaaaatagtgagcgctacccgtgggactccctgaccgattctcgtgggtcccactcgagggaacgaccgacccaccctgaccataccaaacg

SEQ ID NO: 444325 - DNA, 457 bp, Homo sapiens
  misc_feature: NA.52.37.D04.1.454.light.2.nb
  modified_base (304)..(304): a, c, t, g, unknown or other
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattggtacttataattctgtctctggtaccaacaactaccccggacaaacgtccccaaactcatgatctttgaggtcagtgatcggcccgcaggggtttctcatcgcttcctccggctccaagtctggcngcacggcctccctgaccatctctgggctccaggctgaggacgaggctgattatactgcagctcatatacaaacagaaacacgttgggtgttcggcgggcgggaccaaacgtcgaccggtcctacgttcacgcccaaggcctcgccccctcggt

SEQ ID NO: 444326 - DNA, 413 bp, Homo sapiens
  misc_feature: NA.52.38.D05.1.454.light.2.nb
  modified_base (178)..(178): a, c, t, g, unknown or other
tccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccggcaggcccctgtgtggtgatgtataaagacactgagacggccctgagggactcccgtgagcgattctctggctccgaggtcagggacaacggtcacattggccatcagtggagtccaggcagaggacgaggctgactattattattgtcaatcaaacagacaccattggtacttatgtcttcggaactgacgaccaaggtccaccgtct

SEQ ID NO: 444327 - DNA, 248 bp, Homo sapiens
  misc_feature: NA.52.4.A04.2.454.light.2.nb
cagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggagaaatatgttctggtatcgcagagccaggccagtcgctgtcctggtcatctatcacgataagacgcggccctgacgggactcccga

SEQ ID NO: 444328 - DNA, 261 bp, Homo sapiens
  misc_feature: NA.52.4.A04.3.454.light.2.nb
cagcatcggaggtgcctcagccatggcatggatccctctcttcctcctcgtccttgcttactgcacaggatgtgtggcctcctatgaggtgactcagacaccgtcagtgtccgtctccccaggacagacagccagcatcagctgttctggagataaatggagataaatatgttctggtatcgcagaagccaggccagtcgcctgtcctggtcatctatcacgataagaagccggcctcgagggatccctgagcgattctct

SEQ ID NO: 444329 - DNA, 256 bp, Homo sapiens
  misc_feature: NA.52.43.D10.1.454.light.2.nb
  modified_base (132)..(132): a, c, t, g, unknown or other
  modified_base (233)..(233): a, c, t, g, unknown or other
taggacccagacggaaccatggaagccccagcgcagcttctcttcctcctgctactctggctcccagattctactgaagaaatagtgatgacgcagtctccagccaccctgtctgtgtctccagggggaacncagtccaccctctcctgcagggccagtcagtactgttaacaccaacttagcctggtaccagcacaaccgtggcccggctcccaggctcctcatctatggtncatccaccaggggcccacgtggt

SEQ ID NO: 444330 - DNA, 288 bp, Homo sapiens
  misc_feature: NA.52.5.A05.1.454.light.2.nb
cagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgtttcctggtatcagcagaagccaggccagtctcctgttctcctcatctataaagatgtacaagcggccctcgagggactcccgtgagcgattctctggctcatctggaaatgcagc

SEQ ID NO: 444331 - DNA, 338 bp, Homo sapiens
  misc_feature: NA.52.50.E06.1.454.light.2.nb
caggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatattggtaccggagaagccaggccaggcccctgtgttggtgatatataaagacagggagacggcccccgagggactccctgagcgatactctcggctccagctcaagggacaacgagtcacattgaccatcagtgatccgaggcagaagacgaggct

SEQ ID NO: 444332 - DNA, 361 bp, Homo sapiens
  misc_feature: NA.52.52.E08.1.454.light.2.nb
gactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggttcagcagagccaggccaatctccaaggcgacctaatttataaggtttctcaccggactccgtggggtcccagacagattcagcgcagtggtcaggcactgatttcacgctagaaaatcagcgagggtggaggctagaagagttggttaggggttta

SEQ ID NO: 444333 - DNA, 186 bp, Homo sapiens
  misc_feature: NA.52.52.E08.2.454.light.2.nb
  modified_base (176)..(176): a, c, t, g, unknown or other
aggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatattctgtactaaaaccgtttntgtacttagt

SEQ ID NO: 444334 - DNA, 433 bp, Homo sapiens
  misc_feature: NA.52.53.E09.3.454.light.2.nb
tgctcgatttagagagagtgtgttgggtttggggagcagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaacggccctggtactgatgagctacaacagtgatggcagccacgagcgacgggggacgtatccctgatcgcttctcgaggctccggctcgtgggactgagcgctacctcaccatctccagccctccagtctagaggacgagggtgactattactgtcagacgtgggacagtggctagtttggggtgttcggg

SEQ ID NO: 444335 - DNA, 303 bp, Homo sapiens
  misc_feature: NA.52.53.E09.4.454.light.2.nb
tccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaacgcccggcacggcccctgtcttgtcttattaataaagtactttgagacgccctcgacgggacccctgacgcgacttctctcggctccagctcagcgaacaac

SEQ ID NO: 444336 - DNA, 367 bp, Homo sapiens
  misc_feature: NA.52.54.E10.1.454.light.2.nb
ctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagacggccctcgagggactcccgtgagcgtattctctggctccgaggtcagggacaacggtcacattggccatcagtgagtccaggcagaggacgaggctgactattatg

SEQ ID NO: 444337 - DNA, 271 bp, Homo sapiens
  misc_feature: NA.52.56.F01.1.454.light.2.nb
  modified_base (183)..(183): a, c, t, g, unknown or other
tcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaaggagacagcctacaagtaaacttttangcaagttgtaaccaacagaagccaggacaggcccctgtagctgtcatatatggtgaatctatcggcctcgagggactcccagaccccg

SEQ ID NO: 444338 - DNA, 372 bp, Homo sapiens
  misc_feature: NA.52.57.F02.1.454.light.2.nb
caggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtcttatgactttgtctcctggtaccaacaccaccctggacaaacgcccccaaactcatctattttgagtcactaagcgcctcgagggtccctgatcgcttctcctggctcgaagtctggcacacggcctccctgaccgtctctgggctccaggctgaggatgaggctgattactactgcacctcatactgcaggc

SEQ ID NO: 444339 - DNA, 325 bp, Homo sapiens
  misc_feature: NA.52.59.F04.1.454.light.2.nb
  modified_base (301)..(301): a, c, t, g, unknown or other
ctcagccaggacacagcatggacatgagggtccctgctcagctcctgggactcctgctgctctggctcccagataccagatgtgacatccagatgacccagtctccatcctccctgtctgcatctgttggagacagagtcaccatctcttggccgggcagtcaggtcattaacagttattagcctggtatcagacaaaacggacaagttcctgaactcctgatctatgacacatccactttgcaatccgaggggtcccatctcggttcgttggcagtgggtctggggactagtattttacnctcaccatcagcagcctgcagcct

SEQ ID NO: 444340 - DNA, 450 bp, Homo sapiens
  misc_feature: NA.52.6.A06.1.454.light.2.nb
ggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatctttgaggtcagtgatcggcccgcaggggtttctcatcgcttctccggcctccaagtctggcagcacggcctccctgaccatctctgggctccaggctgaggacgaggctgattatactgcagctcatatacaagcagaaactacgttgggtgttcgggcggacggggaaccaaacgttcgaccgtcacgttcacgccaagcctcgccccttggtcc

SEQ ID NO: 444341 - DNA, 407 bp, Homo sapiens
  misc_feature: NA.52.60.F05.1.454.light.2.nb
  modified_base (155)..(155): a, c, t, g, unknown or other
  modified_base (174)..(174): a, c, t, g, unknown or other
gaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtcaaaccgttntgcttattggtaccagcagaagccaggccaggcccctgtgttggtgatatataaggacactgagaggccctgagggatccctgagcgattctctcggcctccacctcagggacactgtcacgttgaccatcagtgagtccaggcagaggacgagctgactaccactgtacaatcaacagacagcagtgttctatgtcttcgcaactcgggacaaggtcacgtctaggtcagcc

SEQ ID NO: 444342 - DNA, 372 bp, Homo sapiens
  misc_feature: NA.52.65.F10.1.454.light.2.nb
aggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcagtcaggttgtagcgcctggttagcctggtatcagcagaaaccagggaaagcccctaaagtcctggtctatgctacatccaatttgcaaagtggcgtccctcaaggttccgcggcagtggatctgggacaaatttcactctcaccatcagcagcctgcagcctgaagtattttgcgtacttactattgtacaacagggggtactagtttccgtactaccttt

SEQ ID NO: 444343 - DNA, 372 bp, Homo sapiens
  misc_feature: NA.52.67.G01.1.454.light.2.nb
ggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggccttcgttttcagtgatggaaacacctacttgaattggttcaccagaggccaggccaacctccaaggcgccttaatttataaggtttctaaggcggactcgtcggggtcccagacagattcagcggcaggtgggtcaggcactgatttctcactgacaaatcaggcggggtggaggctggaggattggttggggtttatacgtg

SEQ ID NO: 444344 - DNA, 342 bp, Homo sapiens
  misc_feature: NA.52.68.G02.1.454.light.2.nb
tcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcacaacagtgtattttggggttatgattctgtcttcgtggtaccaacggcaccaggcaaacgtccccaaatcatgattactgatatcaaataagacgccctcgacggggtccccctgactcgcttctctggctccaagtctgcaacacggccctccctgacccatctctgggctccaggctg

SEQ ID NO: 444345 - DNA, 467 bp, Homo sapiens
  misc_feature: NA.52.7.A07.1.454.light.2.nb
agcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggattataaacttgtctcctggtaccaacaacacccggcaaacgcccccaaactcatcatttatgaggtcactaagcggccctcgggggtttctaatcgcttctctggctccaagtctcggcgacacggcctccctgacaatctcttggctccaggctgagacgaggctgattattttgctgctcatatgcgggtagtagtaattatgtcttcggaagtgggaccacggtcaccgtcctgggtcagcccaaggcccaacccacttcgcactctcgttcccaccctccttctaattcgaa

SEQ ID NO: 444346 - DNA, 370 bp, Homo sapiens
  misc_feature: NA.52.71.G05.1.454.light.2.nb
gttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcacgaccccaggccaggctccacgcacgctcatctacagcacaattactcgctcttctggggtccctgactcgcttcctctgcctccatcccgttagggaacaagctgaccctaacatcgacggggcccaggcagatgatgaatctgattattactgtgtcctctatagtgggta

SEQ ID NO: 444347 - DNA, 372 bp, Homo sapiens
  misc_feature: NA.52.72.G06.1.454.light.2.nb
caggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctctgtaccaacaataccccggcaaagtccccaaactcatgatctttgagtcagtgatcggcccgctaggggtttctcatcgcttcctccggctccaagtctggcgcacggcctccctgaccatctctggctcagctgagacgaggctgattatactgcagctcatatacaaactagaaa

SEQ ID NO: 444348 - DNA, 353 bp, Homo sapiens
  misc_feature: NA.52.73.G07.2.454.light.2.nb
gttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagacgcctctgcatagtaatggatacaagtattggattggtatctgcagaagccgagggcagtctccacagctcctgattcttagtttgggtactaagtccgggcccctccggggtcctggagtaggttcagtggcaggtggatcgaggcacagtatttaacaactaaaatcagacagagtggagcgtaggaggtagtt

SEQ ID NO: 444349 - DNA, 302 bp, Homo sapiens
  misc_feature: NA.52.74.G08.1.454.light.2.nb
  modified_base (142)..(142): a, c, t, g, unknown or other
  modified_base (270)..(270): a, c, t, g, unknown or other
cagcatcgggggtgccgcagccatggcctggaccgctctccttctgagcctccttgttcactttacaggttgtctggcctcctatgaactgactcagcctctctcagtgtcagtggccctgggacagacgccacaattaccnggcggggagacaatattgtgaccagacatgtgcactggtatcagcagaagccaggccaggcccctgtcctggtcatctagtaggatattaagcggccctctggaactccctgagcgattccactggcncaattcggacacgcggccacctgaccatcagt

SEQ ID NO: 444350 - DNA, 306 bp, Homo sapiens
  misc_feature: NA.52.75.G09.1.454.light.2.nb
tttagtatagacatcaggggggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtgacattggtcttaataactatgtctcctggtaccgacaacaccccggcaaacgcccccaaactcatgatttatgctgtcacttatcggcccgcagggtatttctcatcgct

SEQ ID NO: 444351 - DNA, 455 bp, Homo sapiens
  misc_feature: NA.52.76.G10.1.454.light.2.nb
tttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggacaaacgtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacgttgggtgttcggcggcgggacaaaacgtgaccgtctacgtc

SEQ ID NO: 444352 - DNA, 382 bp, Homo sapiens
  misc_feature: NA.52.77.G11.2.454.light.2.nb
tcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactattaaattggtatcagctagaaacccggaagcccctaagctcctgactcctcgatgcattcactttggaaacaggggtcccatcaaggttcagtgggagtggctcgtgggactagtattttacttcaccatcagcagcctgcagcctgagatattgacaacatatactgtacaacagtacataatctaccgctctacgtttcgg

SEQ ID NO: 444353 - DNA, 427 bp, Homo sapiens
  misc_feature: NA.52.80.H03.1.454.light.2.nb
aggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcgagggatccctgagcgcttctcctggctccacctcgaagggacaatggtcacattgaccatcagtgagtccaggcagaagcgaggctgactatttctgtacaatcttcagacatcagtggtacttatgtcttcggaactgggaccaggttcaccgtcttaggttcagcccaaggcccaa

SEQ ID NO: 444354 - DNA, 344 bp, Homo sapiens
  misc_feature: NA.52.80.H03.2.454.light.2.nb
caggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctctgtaccaacaacacccggacaaacgaccccaaatcatctattttgagtcactaagcgcctcgacgggtccctgactcgcttctctggcctccaaagtctggcaacacggcctccctcgacccgtctcgtcgggcctccagtctgacga

SEQ ID NO: 444355 - DNA, 393 bp, Homo sapiens
  misc_feature: NA.52.82.H05.1.454.light.2.nb
cgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcgagggactccctgagcgattctctggctccacctcagggacacgtagtcacgttgaccatcagtggagtccaggcagaggacgaggctgactacactgtacaagtcaaaca

SEQ ID NO: 444356 - DNA, 333 bp, Homo sapiens
  misc_feature: NA.52.83.H06.1.454.light.2.nb
cttctccctctaacactctcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttacttcaccatcagcggcctgcagcctgaagatattgcaacatattactgtcaacagtatggtaatctcccactcactttcggcggagggaccaaggtcgagatcaaagactgtggctgcaccatctgtctcatcttcccgcatctgatatacgatcg

SEQ ID NO: 444357 - DNA, 288 bp, Homo sapiens
  misc_feature: NA.52.85.H08.1.454.light.2.nb
aagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttgggggaaaatatgcttgctggtatcaacagcggccaggccagtcccctgtactggtcatctatctagaatagtaggcggccctcgtgggactcccgtgaccccgtattctctggcctcccactct

SEQ ID NO: 444358 - DNA, 464 bp, Homo sapiens
  misc_feature: NA.52.86.H09.1.454.light.2.nb
tgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggcaggcccctgtgttggtgatgtataaagacactgagaggccctgagggatcccgtgagcgattctctggctccaggtcagggacaacggtcacattggccatcagtggagtccaggcagaggacgaggctgactattatgtacaatcaacagacaccattggtacttagtgtcttcggaactgcgacaaggtcaccgtcttggggttcagcccaaggcc

SEQ ID NO: 444359 - DNA, 330 bp, Homo sapiens
  misc_feature: NA.52.87.H10.1.454.light.2.nb
  modified_base (290)..(290): a, c, t, g, unknown or other
caggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtggggatacaacattaggaaactaaaatgtgcagtggtaccagcagaagccaggccaggcccctgtgttggtcatctatagggatcgaagacgggcctcgtggggattcctgagcgattctctggcctccaactcgganacacggccaccctgaccatcagaacgtgcccaaagtcggt

SEQ ID NO: 444360 - DNA, 308 bp, Homo sapiens
  misc_feature: NA.52.9.A09.1.454.light.2.nb
caggacacagcatggacatgagggtccccgctcagctcctggggctcctgctactctggctccgaggtgccagatgtgacatccagatgacccagtctccatcctccctgtctgcatctgtaggagacagagtcaccatcacttgccgggacaagtcagagcattagcagtcttaatttaaatggtatcagcagaagccaagggaaaccccctaaatcctgatctctgctgctatctagtttgctatactgacgtcccatccaggttcaggtggcggtggatcgtgggactagtactttcacctctac

SEQ ID NO: 444361 - DNA, 388 bp, Homo sapiens
  misc_feature: NA.8.10.A10.1.454.light.2.nb
  modified_base (131)..(131): a, c, t, g, unknown or other
taggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacagggccactggcatcccagccaggttcagtgcaggtgggtctgggacagacttcactctcaccatcagcagcctagacgcctgaagtatttgctactttatactgtcagcagcgtagtaactggtcctttcactttcggccctgggaccaagtg

SEQ ID NO: 444362 - DNA, 431 bp, Homo sapiens
  misc_feature: NA.8.12.B01.1.454.light.2.nb
aggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagaggccaggccagtcccctgtactggtcatctatcaagataacaagcggccctcagggatccctgagcgattctctggctccaactcgtcgggaacacagccactctgaccatcagcgggacccaggctacggatgaggctgactattactgtcaggcgtgggacagcagcacctatgtggtttcggcggtagggaccaagctgaccgtcgttggtcacgcccaggctcgccccc

SEQ ID NO: 444363 - DNA, 369 bp, Homo sapiens
  misc_feature: NA.8.14.B03.1.454.light.2.nb
  modified_base (291)..(291): a, c, t, g, unknown or other
gtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggatcctcccactatctcctagaggtaataaaacagactcaagataaggagcaggcctcgtggacgtccccagccccgcttctctggactaccaaagntgctgcggccaatgcagggagtttgctcatctcgtgggctccgagtttgaggatgaggctgactattattgtatgatt

SEQ ID NO: 444364 - DNA, 232 bp, Homo sapiens
  misc_feature: NA.8.16.B05.1.454.light.2.nb
tgctcagttaggacccagacggaaccatggaagccccagcgcagcttctcttcctcctgctactctggctcccagagatcattggagaagtggtgatgacacagtctccggtcaccctgtcttgtttttccgtggggagagacgcccaccctctcctgtgcggccagtcagagcgttaggacgaacttagcctggtatcagcagaggcctggccaggctccagactcctcat

SEQ ID NO: 444365 - DNA, 178 bp, Homo sapiens
  misc_feature: NA.8.21.B10.1.454.light.2.nb
  modified_base (164)..(164): a, c, t, g, unknown or other
gtctcagtcaggacacagcatggacatgagggtccccgctcagctcctggggctcctgctcctctggctccgaggtgccagttgtgacatccagttgacccagtcctccctcctctctgtctgcttcgtggtgggacgacagcgtcaccatcacttggccgggnagtcagtccaatta

SEQ ID NO: 444366 - DNA, 477 bp, Homo sapiens
  misc_feature: NA.8.28.C06.1.454.light.2.nb
ctgggggaggaactgctcagttaggacccagacggaaccatggaagccccagcgcagcttctcttcctcctgctactctggctcccagagatcattggagaagtggtgatgacacagtctccggtcaccctgtctgtttttcctggggaagagccaccctctcctgtgcggccagtcagagcgttaggacgaacttagcctggtatcagcagaggcctggccaggctcccagactcctcatctttggcgtcctttaacgacggggccaggtggaactcccagccaggttcagcggcaggtgggtctgggacttcgttcactctcaccatcaataacctgacaatctagacgtactttgctagtttattctgtcagcagtctgaagactggtccgttcacgtttcgggcggtagggaaccaagggtcggacctacgaaaacgaactggtggctgcaccatctgtctcactcttcccgc

SEQ ID NO: 444367 - DNA, 422 bp, Homo sapiens
  misc_feature: NA.8.33.C11.1.454.light.2.nb
tgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggcccctcatctatggtgcatccaacagggccactggcatcccagccaggttcagtggcagtgggtatggggacagcttcactctcaccatcatcagcctggagcctgaagatgttgctagtttattactgtacaactatcgtaccgagtcggccgtccgggggccacgtttcggcccgtgggaccaaggtggaga

SEQ ID NO: 444368 - DNA, 465 bp, Homo sapiens
  misc_feature: NA.8.34.D01.1.454.light.2.nb
gctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgctacgtatcctggtaccaacagaaacctggccaggctcccaggcccctcatctatggtgcatccaacagggccactggcatcccagccaggttcagtcggcagtgggtatgggacagacttcactctcaccatcatcagcctggagcctgaggatgttgctagtttattactgtacaactatcgtaccgagtcggcccgtccgggggcctacgtttcggccctagggaaccaaagtggatactacaaacgactgtgctgcacatctgtcttcactcttcccgc

SEQ ID NO: 444369 - DNA, 375 bp, Homo sapiens
  misc_feature: NA.8.37.D04.1.454.light.2.nb
gacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaacctggccaggctccccgactcctcttcttggtggagcctacagggccactggcaccccagacaggatcagtggcaggcgggtctgggacagacttcattctccaccatcaacagactgcagcctagaagatattgctagtttacactgtcagcagtatgttaccgtcccgtgacgttcgg

SEQ ID NO: 444370 - DNA, 369 bp, Homo sapiens
  misc_feature: NA.8.38.D05.2.454.light.2.nb
  modified_base (137)..(137): a, c, t, g, unknown or other
gctcagttaggacccagagggaaccatggaagccccagctcagcttctcttcctcctgctactctggctcccagataccaccggagagattgtgttgacacagtctccagccaccctgtctttgctccaggggaaanagccaccctctcctgcagggccagtcagagtgttaccacccagttagcctggtaccaacacaaacctggccaggctcccaggcccctcatctttgatgcatccatcaggccactggcatcccagccaggttcagtggcagtgggtctgggacagacttcaactctcaccatcagcagcctagacgcctagaagtattttgctagtttattactgtacaacatcgtaccgagt

SEQ ID NO: 444371 - DNA, 420 bp, Homo sapiens
  misc_feature: NA.8.4.A04.1.454.light.2.nb
  modified_base (222)..(222): a, c, t, g, unknown or other
aaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctnttggtaccagcacgaccccaggccaggctccacgcatgctcatgtacagcaacaaacattcgctacttcgtcggggtccccctgactcgcttctctggctccatccgttagggaacaaagctcgccctcaccatcgacggggcccaggcagatgatgaatctactattattactgtgcactgctatttgcgtgatgtc

SEQ ID NO: 444372 - DNA, 439 bp, Homo sapiens
  misc_feature: NA.8.42.D09.1.454.light.2.nb
aggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacaccagacaaacgccccaaactcatgtattttgagtcaataagcgcctcgacggggtccctgactcgcttctcaggctcccaagtctggcaacacggcctccctgaccgtctctgggctccagactgaggatgaggctgattattactgcagctcatattcaggcagcaacgagggtatcggcggaggaccaagttcgaccgtctaggtcacgcccaaggctcgccccggtcactctcgtccc

SEQ ID NO: 444373 - DNA, 450 bp, Homo sapiens
  misc_feature: NA.8.43.D10.2.454.light.2.nb
cttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattatagtacaaacaacagacactcctggacccctgcccggttctcacggctcccctccttcggggccaaagctcgccctgacaactgtcaggtgtgcagccctgaggacgaggctgagtattactgcctgctctattaggtgggtccgttgggtgttcggcggagggaccaagctgaccgtcgtaggtcagcccaaggcctcgccccttcgggttcactctcgttccc

SEQ ID NO: 444374 - DNA, 374 bp, Homo sapiens
  misc_feature: NA.8.49.E05.1.454.light.2.nb
agtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactacttaaatggtatcagcagaaaccagggaaaccccccaaatcctgatcaattatgcatccagtttgacaaagtcgggtccccatacaagattcaagtggcggtggatcgtgggacagatttcactctcacatcaacagtctgcagattgaggtattatgtactaacttattactgtcagtcagtagttcca

SEQ ID NO: 444375 - DNA, 290 bp, Homo sapiens
  misc_feature: NA.8.5.A05.1.454.light.2.nb
ggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtgcatcaatgttggtacctagagggtatactggtaaccaacagaagccgagggactccctaccccagaactcctcctaggtataacaaatcaagactcagataggcagcaggcctcgtcggactccccagccgtcttctctgg

SEQ ID NO: 444376 - DNA, 432 bp, Homo sapiens
  misc_feature: NA.8.67.G01.1.454.light.2.nb
ctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttatggtgcatccatttcgacaaaggtcgggtcccatcaaggttcagtggcagtggatcgtggggcagactttcaccctcaccatcagcagtctgcaacctgaagtactttgactaacttctactgtcagcagtcttacagtaggccggctaccgtttggccgaggggacgaagcgtaggagagtacgaaacgaacgtggtgctgcaccatctgtcttcatcttcccgcatctgacgacacgcgag

SEQ ID NO: 444377 - DNA, 439 bp, Homo sapiens
  misc_feature: NA.8.71.G05.1.454.light.2.nb
tctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaatggtatcaaacaaaaccaggaaagcccctaaatacctggtctatactgcatccactttgcaaagtggggtcccatcaaggttcagtggcagtggatttgggactagtttcactctcacaatcagcagtctcgaacctgaagtattttgactaaacttactactgtacaacagacttacaatataccgagacgttcgtacaagggaccaaggtggagatacaaaacgaactgtaggctagcaccatctgtcttcatc

SEQ ID NO: 444378 - DNA, 389 bp, Homo sapiens
  misc_feature: NA.8.73.G07.1.454.light.2.nb
tactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccgagggtgaggatgaggctgattattactgccacctcctatgacaacagcctgagtatttggctgttcggcggcgggaccaagttgaccgtcctacgtcagcccaaggctcgccccctcggtcactctcgttccccaccctcctcgaccacgcgag

SEQ ID NO: 444379 - DNA, 324 bp, Homo sapiens
  misc_feature: NA.8.80.H03.1.454.light.2.nb
cagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcagggtattagcagctacttagcctggtatcagacagaaaccgagggaaacgcccctaacctcctgatccatactgcatccagcttgacaaaggtcggggtacccagtccaaggttcagcggcagtggaatcgtgggacagatttcactctcaccatcagcagcc

SEQ ID NO: 444380 - DNA, 323 bp, Homo sapiens
  misc_feature: NA.8.81.H04.1.454.light.2.nb
agtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttcccggacacttttggccggggaccaagctggagatcaaacgaactgtggctgcaccatctgtcttcatcttcccgccatctgagacacgcgag

SEQ ID NO: 444381 - DNA, 430 bp, Homo sapiens
  misc_feature: NA.8.88.H11.1.454.light.2.nb
  modified_base (145)..(145): a, c, t, g, unknown or other
agagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagagtagttatttagcctggtatcggcaaaaacctggccaggctccccgactcctcttcttggtggagcctacagggccactggcaccccagacaggatcagtggcagcgggtctgggacagacttcattctcaccatcaacagactgcagcctgaagatattgctagtttactactgtcagcagtatgttacgtcccgtggacgttcggaccaaggggaccaaggtggacaatcaaccgaatgtgctgca

SEQ ID NO: 444382 - DNA, 306 bp, Homo sapiens
  misc_feature: NA.9.1.A01.1.454.light.2.nb
ctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctctgtatcaacaacacccaggcaaacgccccccaatcattatttctgatgtacaacaatcggcccccagggtactttctgatcgtccttctctggctccaaagtctggcaa

SEQ ID NO: 444383 - DNA, 296 bp, Homo sapiens
  misc_feature: NA.9.11.A11.1.454.light.2.nb
cttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagatttgcagtttatactgtcagcagtatggtagctcaccgtactacttttggccaggggaccaagctggagatacaaacgaactgtcggctgcaccatctgtctcatccttccc

SEQ ID NO: 444384 - DNA, 440 bp, Homo sapiens
  misc_feature: NA.9.12.B01.2.454.light.2.nb
agctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttatacggctccgaacaacaagaactacttagcttggtatcagcagaaaccaggacagcctacctaaactgctcattaactgggcatcctacccccggcaatccggggtccctgaccgattcagtggcagcgggtctggggacagatttcactctcaccatcagcagcctgcaggctgaagatgtgctagtttatactgtcaactgttttctcgggtcgttcggccgaacgggaccgaagggtacggaaatacgaaaacgtaac

SEQ ID NO: 444385 - DNA, 424 bp, Homo sapiens
  misc_feature: NA.9.12.B01.3.454.light.2.nb
gtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactgggcatctacccggcaactccggggtccctgaccgattcagtggcagcgggtctgggacagatttcactctcaccatcagcagcctgcaggctgaagatgtggctagtttatactgtacaactagttttccggggtcgtttcggccgaagggaccaaggtaggaaatacaaacgaactgtggctgcaccattctgtcttcatc

SEQ ID NO: 444386 - DNA, 299 bp, Homo sapiens
  misc_feature: NA.9.12.B01.4.454.light.2.nb
  modified_base (239)..(239): a, c, t, g, unknown or other
aggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactattggtcttaataactatgtctcctggtaccaacagcacccaggcaaacgtccccaaatcatgtatttangaggtcaataagcggccctcgtggggtccctgatcgcttctcctggctcaagtctggcac

SEQ ID NO: 444387 - DNA, 462 bp, Homo sapiens
  misc_feature: NA.9.2.A02.1.454.light.2.nb
cagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaatcaataatttatgatgtctttagacggccctcagggtatttcttctcggttgtctggcctccaagtctgggaacacggcctccctgaccatctctggacttcagcctgaggacgagggtgattacttctgcagttcagtattcaagtaaaccttccccgtggtttgggtgttcgggcgggtaggggaccagtcgtcgaccgtctgacgtcacgcccaaggcctcgccccgtcggtcactc

SEQ ID NO: 444388 - DNA, 437 bp, Homo sapiens
  misc_feature: NA.9.20.B09.1.454.light.2.nb
cagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccggcccctggtggtggtcgtctatgataacagtgaccggccctcgtcgatccctgagcgcttctctggctccccaactctgggaacacggcccaccctgacccatcagcagggccgaagccggggatggaggccgactattactgccaggtgtggcatattatcaccccgtgttcgggcgggggaccaagctgaccgtctaggtcagcccaaggctcgccccctcggtccacctctcg

SEQ ID NO: 444389 - DNA, 312 bp, Homo sapiens
  misc_feature: NA.9.24.C02.1.454.light.2.nb
  modified_base (140)..(140): a, c, t, g, unknown or other
  modified_base (234)..(234): a, c, t, g, unknown or other
tgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctagtagcctggtaccaacagaatcctggccaggctcccaggcctcctcatttangatgcataccaaacggcccacgtggccgtcccagccaggttcaggtggcaggtcgggtctggggacagtacttcactc

SEQ ID NO: 444390 - DNA, 339 bp, Homo sapiens
  misc_feature: NA.9.25.C03.1.454.light.2.nb
acattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcaggcggggtcgaagccggggatgaggccgactatttctgtcagctggtggattctcatgatggtaggtgggggaatcgttcgggcggagggaccccagggctgaccgtccgtaaagtcaagccccaagggctcgccccc

SEQ ID NO: 444391 - DNA, 286 bp, Homo sapiens
  misc_feature: NA.9.25.C03.2.454.light.2.nb
aaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacaattaaaacaaataatgtgcattggtaccagcagaagccaggccaggcccctgtcctggtcgtctttgatgatagtcgacccggccctcgagggactcccgtgagcgtattcc

SEQ ID NO: 444392 - DNA, 381 bp, Homo sapiens
  misc_feature: NA.9.27.C05.1.454.light.2.nb
tgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaaccaacagagacctggccagcctcccaggcctcctcatctttgatgcatccactagggccagtggaactcccagacaggttcagtggccaggtgggtctggggacagagttcactctcagcatcaaacagcgtggcgggctagaagttatttttgtttttatattgtcagtctagtatgataactggc

SEQ ID NO: 444393 - DNA, 372 bp, Homo sapiens
  misc_feature: NA.9.31.C09.2.454.light.2.nb
  modified_base (367)..(367): a, c, t, g, unknown or other
tcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaacgcccccaatcattatttctgatgtcaacaatcggcccccagggatttctgatcgccttctctggctccaagtctggcaacacggcctccctgaccatctcctgggctcgggctgaggacgagctcactattacctgcgctcatanacaac

SEQ ID NO: 444394 - DNA, 444 bp, Homo sapiens
  misc_feature: NA.9.33.C11.2.454.light.2.nb
gctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaacctggccaggctcccaggcccctcatctttgatgcatccatcagggccactggcatcccagccaggttcagtggcaggtgggtctgggacagacttcctctcaccatcagcagcctagagcctgaagtatttgctagtttattactgtacaacatcgtaccgagtcggccgtccgggggcctacgtttcggccctgggaccaaaagttcgaagactacaaacgactagtcggctgcaccaatc

SEQ ID NO: 444395 - DNA, 496 bp, Homo sapiens
  misc_feature: NA.9.34.D01.2.454.light.2.nb
tcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcgacggggtccctgaccgattctccggctccaagtctggcacatcagcctccctggccatcactgggctccaggctgaggatgaggctgactattactgccagtcgtatgacagtggacctaagtaacatcgtcttcggaactgggaccaaggtcaaccgtctgggtcagcccaagcccaaccccactgtcactctcgttccccaccctcctcacgacgtatca

SEQ ID NO: 444396 - DNA, 183 bp, Homo sapiens
  misc_feature: NA.9.34.D01.3.454.light.2.nb
agaggcagcgctctcgggacgtctccaccatggcctgggctctgctgctcctcaccctcctcactcaggacacagggtcctgggcccagtctgccctgactcagcctgcctccgtgtctgggtctctggacagtcgatcaccatctctgcactggaaccagcagtgagttggttgggattatg

SEQ ID NO: 444397 - DNA, 454 bp, Homo sapiens
  misc_feature: NA.9.38.D05.1.454.light.2.nb
ctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggacaaacgcccccaaactcttgctttatgatgtcagttatcggccctcaggagtttctgatcgcttctctggctccaagtctggcaccacggcctccctgaccatctctgggctccaggctgaggacgaggctgattattctgcagctacaaaaagagtagccctcgtcgtggtttcggcgggggaccaaggtcgaccgtctaagtcagcccaaggctcgcccctggtcactctcgtccc

SEQ ID NO: 444398 - DNA, 398 bp, Homo sapiens
  misc_feature: NA.9.39.D06.1.454.light.2.nb
  modified_base (141)..(141): a, c, t, g, unknown or other
  modified_base (294)..(294): a, c, t, g, unknown or other
ctgctcagttaggacccagacggaaccatggaagccccagcgcagcttctcttcctcctgctactctgggtcccagataccactggagaaatagtgatgacgcagtctccagccaccctggctgtgtctccgaggggaaangccaccctctcctgcagggccagtcagagtgttagtagtaggttagcctggcaccagcaaaacctggccagcctccaggctcctcatctatgatgcatccaccaggaccactggtcgtcccagccaggttccagtgggagtgggtctgggacngagttcactctcacatcagcagtctgcagtcggaagtatttgcagtttactattgtcagcagtatagtaacggcgctctactttcggacggtagggaccaaggg

SEQ ID NO: 444399 - DNA, 328 bp, Homo sapiens
  misc_feature: NA.9.43.D10.2.454.light.2.nb
  modified_base (290)..(290): a, c, t, g, unknown or other
agcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtgttatgactatgtctcctggtatcaacaacacccaggcaaacgccccaaatcttgatttatgaggtcagtaggacgccctcgacggggtccctgactcgcttctctggctccaagtctgcccaacncggccctccctgacccgtctcgtgggctccgaggctga

SEQ ID NO: 444400 - DNA, 401 bp, Homo sapiens
  misc_feature: NA.9.50.E06.1.454.light.2.nb
  modified_base (141)..(141): a, c, t, g, unknown or other
ctgctcagttaggacccagagggaaccatggaagccccagctcagcttctcttcctcctgctactctggctcccagattccaccggagaagttgtgttgacacagtctccagccaccctgtctttgtctccgaggggaaangccacctctcctgcagggccagtcagagtcttaggagctccttagcctggtatcaacagaaacctggccaggctcccaggcctcctcatctatgatgcatccaacagggccatggcatcccagccaggttccagtggcagtgggtctgggcagacttcactctcaccatcagcagactagagcctagaagtatttgctagtttattactggtcagcagcgtagcaacgtggcctcggacgttcggccgaagggaccaaag

SEQ ID NO: 444401 - DNA, 413 bp, Homo sapiens
  misc_feature: NA.9.52.E08.1.454.light.2.nb
ctgctcagttaggacccagagggaaccatggaagccccagcccagcttctcttcctcctgctactctggctcccagaaaacgccggagaaattgtgttggcacagtctccagccaccctgtctatgtctccaggggaaagagccacctctcctgcagggccagtcagagtgttggtacgtcttactctggtaccaaacaaaacctggccaggctcccaggctcctcatctatgatgcatccaccagggccactggcactccccgcagattcagtggcaggtgggtctgggacagacttcgctctcacatcagcagcctggaccctgaacgtattttgctagtttattactgtcagcagcggaccaagttcggcccctctccctcgtacgtttcgggcgggggtaccaagggtg

SEQ ID NO: 444402 - DNA, 451 bp, Homo sapiens
  misc_feature: NA.9.53.E09.3.454.light.2.nb
cacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgcccccaaatcatcatttatgaggtcactaagcggcctcgaggggtttctattcgcttctctggctcaagtctgacaacacggcctccctgacaatctctgggctccaggctgaggacgaggctgattattactgctgctcatatgcagatggtgacactcccgtggtattcgggcggagggaccaaggtcgaccgtccgtaaggtcacgcccaaggcctcgcccccg

SEQ ID NO: 444403 - DNA, 451 bp, Homo sapiens
  misc_feature: NA.9.59.F04.1.454.light.2.nb
cagacccagtcaggacacagcatggacatgagggtccccgctcagctcctggggctcctgctgctctggttccccggttcgagatgcgacatccagatgacccagtctccatcttccgtggctgcatctgtgggaactcagtcaccatcaattgtcgggcgagtcaggatggttggcgaccgcttagtctggtatcagcaagaaaccaggaaaagccctagactcctaatctatggtgcgtcccggttgcacagtggcgtcccaggaacgattcagcggcggtggatcgtagggcagatttcactctcacatcaatcactgcaggctgaggtatttgactaacttactactgtcagcaggctaacgaggctcgaccccctaaacgttccggaccaggggacacggacgttacgggaagtaaacttaaaacggaaacttgggtcggacctta

SEQ ID NO: 444404 - DNA, 387 bp, Homo sapiens
  misc_feature: NA.9.64.F09.2.454.light.2.nb
tcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcaagaaaccgagggaaacgcccctaaactcctaatctatgatcgcctcctagttttaggaaagtcggggtacccatcaaggttcagccggcagtggatcgtagggacagaattcactctcacatcagcagcctgcagcctgatgtatttgactaaactttattactgacaacgcctaataactggtactttccggcct

SEQ ID NO: 444405 - DNA, 437 bp, Homo sapiens
  misc_feature: NA.9.67.G01.1.454.light.2.nb
tgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccacgtggtatcccggcaggttcaggtggtagtgggtctggggacagagttcgtctcaccatcagcagcctgcagtctgaagtatttgctagtttatactgtcagcactataatagttgccgctcactttcggcggtagggaccaagggtggagctacaaacgaactgtggctgcaccatctgtctc

SEQ ID NO: 444406 - DNA, 441 bp, Homo sapiens
  misc_feature: NA.9.71.G05.1.454.light.2.nb
caagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgaggtcactaagcggccctcgaggggtttctggtcgcttcctctgcctccaagtctggcaacacggcctccctgacaatctctgggctccagtctgacgacgaggctgattattactgcagctcatatgctagttggttccttctttacaagtatacgttcggcggagggaccaggctgaccgtctgagtcagcccaaggc

SEQ ID NO: 444407 - DNA, 416 bp, Homo sapiens
  misc_feature: NA.9.74.G08.1.454.light.2.nb
cagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattaggaaagtaaaagtgtgcactggtatcagcagaggccaggccaggcccctgtactggtcctctatgatgacagtcggcccggccctgagggactcccgtgagcgattctctggccctccaagtctggcagccggccacctgaccatcagcagggtcgaaggccggggatggacggccgactattacgtgtcaggtgtggtagttttaatagtgatcagtccgggggtattcgggcggagggaccgaaggtcgaccg

SEQ ID NO: 444408 - DNA, 420 bp, Homo sapiens
  misc_feature: NA.9.75.G09.1.454.light.2.nb
agtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagatgttcttagttggttgctggtatcagcagaaaccgggaagcccctaaactcttgatctatgaggcctctggtttacaaagtggggtcccatcaagattcagcggcagtggatcgtgggacagaattcactctcaccatcagcagtctgcagcctgatgtattttgctaacttattactgaccaaacagtaataatagtttatcccgtaggtactagtttacgggaccgtaaaggggaccggtaagggttacgggaaaa

SEQ ID NO: 444409 - DNA, 395 bp, Homo sapiens
  misc_feature: NA.9.76.G10.1.454.light.2.nb
gactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtagtaaactggtatcagcagctcccgggaaagctcccaaactcctcatctattatgatgatctgctgccctgaggggtctctgaccgattctctggctccaagtctggcacctcagcctcctgccatcagtgggctccagtctgagatgagctgattattactgtggagcagtgggatgacagcctgaatgcttggattgtcggcggagggccaagctga

SEQ ID NO: 444410 - DNA, 423 bp, Homo sapiens
  misc_feature: NA.9.81.H04.1.454.light.2.nb
gcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtcttataactatgtctcctggtaccaacagcacccaggcaaagtccccaaactcatgatttagaggtcaataagcggccctctggggtccctgatcgcttctcctggctccaagtctggcacacggcctccctgaccgtctctgggctccaggctgacgatgaggctgattatactgcagctcatatgcaggcaccacaatgtcttcggaagtcggaccacggtcaccgtctaggtcagcccaaggccaacc

SEQ ID NO: 444411 - DNA, 354 bp, Homo sapiens
  misc_feature: NA.9.86.H09.1.454.light.2.nb
tcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggattttaacctgtctcctggtaccaacaccaccaggcaaacgccccaaatcatgatttatgaagtcactaagcggccctcggggatttctgctcgcttctctggcctccaagtccgtacaacacggcctccctgacaatctctgggctccagactgaggacgaggctcattattactgt

SEQ ID NO: 444412 - DNA, 382 bp, Homo sapiens
  misc_feature: NA.9.9.A09.1.454.light.2.nb
tgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcacctcagccctccctggccatcactgggcttcaggctgaggatgaggctgattatactgccactcctatgacagcagcctgagaagtgtggtatcgggcggaggaccaagctgaccgtctaggtcagcccaaggctcgcccctggtcactctcgttccccaccctcctcagacgtatca

SEQ ID NO: 444413 - DNA, 324 bp, Homo sapiens
  misc_feature: HEFZJCU01EW9MS.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgcttcaggagcacctctgggggcacagcggccctgggctgcctggtcaaggactacttcccatactcgta

SEQ ID NO: 444414 - DNA, 323 bp, Homo sapiens
  misc_feature: HEFZJCU01CST6O.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcttccaccaagggcccatcggtcttccccctggcaccctcctccaagagcacctctggggcacagcggccctgggctgcctggtcaaggaccacttcccatactcgta

SEQ ID NO: 444415 - DNA, 312 bp, Homo sapiens
  misc_feature: HEFZJCU01CQSUU.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacg

SEQ ID NO: 444416 - DNA, 323 bp, Homo sapiens
  misc_feature: HEFZJCU01DC6GD.47.38.D05.1.454.heavy.3.raw
agctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 444417 - DNA, 397 bp, Homo sapiens
  misc_feature: HEFZJCU01ELE5L.16.29.C07.1.454.heavy.3.raw
tgtactactccacgaccggtgctcgatttagagtgctacgaagggaaaggggctggagtgggtctcagctattagtattagtggtgatagcacatactacgcagactccgtgaagggccggttcaccatctccagagacaattccaagaatatgttgtatctgcaaatgaacagcctgagagccgaggacacggccgtatattactgtgcgaaagatgtaaagtgggcgctactggactcggggcttttgatatctggggccaagggacaatggtcaccgtctcttcagcctccaccaagggcccatcggtcttccccctggcaccctcctccaagagcacctctggggcacagcggccctgggctgcctggtcaaggactacttccgagtagtaca

SEQ ID NO: 444418 - DNA, 309 bp, Homo sapiens
  misc_feature: HEFZJCU01DJCNQ.18.53.E09.1.454.heavy.3.raw
tacgagtatgcacgaccggtgctcgatttagagagagtgtgttgggttgggtgcccaagctgctggagggcacggtcaccacgctgctgagcagcctgagatctgaggacacggccgtgtattactgtgctagagagggacgtatagtgggagctccctttgacttctggggccagggaaccctggtcaccgtctcctcagcttccaccaagggcccatcggtcttcccctggcgccctgctccaggagcacctctgggggcacagcggccctgggctgcctggtcaaggactacttcccatactcgta

SEQ ID NO: 444419 - DNA, 378 bp, Homo sapiens
  misc_feature: HEFZJCU01CX829.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 444420 - DNA, 350 bp, Homo sapiens
  misc_feature: HEFZJCU01CX22T.40.36.D03.1.454.heavy.3.raw
tctagcgactcacgaccggtgctcgatttagctgcgtcacgatctctcttggggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 444421 - DNA, 307 bp, Homo sapiens
  misc_feature: HEFZJCU01CEVNU.49.35.D02.1.454.heavy.3.raw
agtcgagagacacgaccggtgctcgatttagcacacgatagttggtttggggggaagaggaagactgacggtcctcccaggagttcaggtgctgggcaccgtgggcatggggaggtgtgtcacaagatttgggctctgggcaccgtgggcatggggaggtgtgtcacaagatttgagccctggtcaccgtctcctcagcttccaccaagggcccatcggtcttccccctggcgccctgctccaggagcacctctgggggcacagcggccctgggctgcctggtcaaggactacttcctctctcgact

SEQ ID NO: 444422 - DNA, 315 bp, Homo sapiens
  misc_feature: HEFZJCU01D5I01.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagct

SEQ ID NO: 444423 - DNA, 338 bp, Homo sapiens
  misc_feature: HEFZJCU01DD76G.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagct

SEQ ID NO: 444424 - DNA, 421 bp, Homo sapiens
  misc_feature: HEFZJCU01C3MVS.3.25.C03.1.454.heavy.3.raw
agacgcactccacgaccggtgctcgatttagtagtgtagatttgggtttggggatggttttctcgatggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccgagtgcgtct

SEQ ID NO: 444425 - DNA, 416 bp, Homo sapiens
  misc_feature: HEFZJCU01CQYXX.3.45.E01.1.454.heavy.3.raw
agacgcactccacgaccggtgctcgatttagtgagtcagtaagggaaaggggctggagtgggtggccaacatagagtacgatggaagtgagaaaactatgtggactccgtgaagggccgattcaccatctccagagacaacgacaagaatttagtgtatctgcaaatgagcagcctgagagccgaggacacggctgtgtattattgtgcgagagataaatattacgatttttggagtggttattatatctcaagtagcgactcgagaggctactggggccagggaatccaggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 444426 - DNA, 396 bp, Homo sapiens
  misc_feature: HEFZJCU01CKQWL.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 444427 - DNA, 381 bp, Homo sapiens
  misc_feature: HEFZJCU01EOH4Q.9.53.E09.1.454.heavy.3.raw
tgatacgtctcacgaccggtgctcgatttagagagagtgtgttggggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 444428 - DNA, 313 bp, Homo sapiens
  misc_feature: HEFZJCU01BI3JJ.11.59.F04.1.454.heavy.3.raw
cgagagataccacgaccggtgctcgatttagtacacacacttagggattggggctgggagaggagcccagcactagaagtcggcggtgtctccattcggtgatcagcactgaacacagaggactcaccatggagtttgggctgaactgggttttcctcgtagctcttttaagaagtgattcatggagaaatagagagactgagtcctccaccaagggcccatcggtcttccccctggcaccctcctccaagagcacctctgggggcacagcggccctgggctgcctggtcaaggactacttccgtatctctcg

SEQ ID NO: 444429 - DNA, 336 bp, Homo sapiens
  misc_feature: HEFZJCU01C55GL.14.28.C06.1.454.heavy.3.raw
cgtctagtaccacgaccggtgctcgatttagagctcacgtattgggtttgggtgccgaagttgctggaggtcacggtcaccacgctgctgagggagtagagtcctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 444430 - DNA, 336 bp, Homo sapiens
  misc_feature: HEFZJCU01CA928.14.28.C06.1.454.heavy.3.raw
cgtctagtaccacgaccggtgctcgatttagagctcacgtattgggtttgggtgccgaagttgctggaggtcacggtcaccacgctgctgagggagtagagtcctgaggtatgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 444431 - DNA, 396 bp, Homo sapiens; identical to SEQ ID NO: 444426
  misc_feature: HEFZJCU01DXGXQ.18.31.C09.1.454.heavy.3.raw

SEQ ID NO: 444432 - DNA, 311 bp, Homo sapiens
  misc_feature: HEFZJCU01D6I33.52.2.A02.1.454.heavy.3.raw
cgcagtacgacacgaccggtgctcgatttagactcatctacagggacaattccgagaacaccctgtatctgcaaatgaacagcctgagagctgaggacacggctgtgtattactgtgcgaacttaatcacggaggacaacggtggcccccgtccgctcggtgcggaggtctggggccaagggaccacggtcaccgtctcctcagcctccaccaagggcccatcggtcttccccctggcaccctcctccaagagcacctctgggggcacagcggccctgggctgcctggtcaaggactacttcctatacgat

SEQ ID NO: 444433 - DNA, 396 bp, Homo sapiens
  misc_feature: HEFZJCU01CX8UC.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 444434 - DNA, 312 bp, Homo sapiens
  misc_feature: HEFZJCU01AYOYV.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactactcctagagacacg

SEQ ID NO: 444435 - DNA, 371 bp, Homo sapiens
  misc_feature: HEFZJCU01CVSO3.3.42.D09.1.454.heavy.3.raw
agacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 444436 - DNA, 339 bp, Homo sapiens
  misc_feature: HEFZJCU01ESPVX.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 444437 - DNA, 368 bp, Homo sapiens
  misc_feature: HEFZJCU01E074V.12.12.B01.1.454.heavy.3.raw
atacgacgtacacgaccggtgctcgatttagtagtgtagatttggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggcgccctgctccaggagcacctccgagagcacagcggccctgggctgcctggtcaaggactacttcctacgtcgtat

SEQ ID NO: 444438 - DNA, 385 bp, Homo sapiens
  misc_feature: HEFZJCU01EBXLN.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 444439 - DNA, 327 bp, Homo sapiens
  misc_feature: HEFZJCU01DFZVP.40.20.B09.1.454.heavy.3.raw
tctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctaga

SEQ ID NO: 444440 - DNA, 322 bp, Homo sapiens
  misc_feature: HEFZJCU01CKQ32.47.38.D05.1.454.heavy.3.raw
agctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttcccctggcaccctcctccaagagcacctctgggggcacagcggccctgggctgcctggtcaaggactacttcctacgtgagct

SEQ ID NO: 444441 - DNA, 398 bp, Homo sapiens
  misc_feature: HEFZJCU01BEXY6.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctggtcaccgtctcctcagcctccaccaagggcccatcggtcttccccctggcgccctgctccaggagcacctccgagagcacagcgaccctgggctgcctggtcaaggactacttccctacagtgct

SEQ ID NO: 444442 - DNA, 375 bp, Homo sapiens
  misc_feature: HEFZJCU01CWX50.48.23.C01.1.454.heavy.3.raw
agtatacatacacgaccggtgctcgatttagtacacgtgattagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 444443 - DNA, 355 bp, Homo sapiens
  misc_feature: HEFZJCU01EG1HT.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagct

SEQ ID NO: 444444 - DNA, 316 bp, Homo sapiens
  misc_feature: HEFZJCU01BCEGB.47.56.F01.1.454.heavy.3.raw
agctcacgtacacgaccggtgctcgatttagcagacgtctgtcgcagggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 444445 - DNA, 336 bp, Homo sapiens; identical to SEQ ID NO: 444430
  misc_feature: HEFZJCU01AK6V5.14.28.C06.1.454.heavy.3.raw

SEQ ID NO: 444446 - DNA, 316 bp, Homo sapiens
  misc_feature: HEFZJCU01BAZ9T.13.66.F11.1.454.heavy.3.raw
tcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttcccctggcgccctgctccaggagcacctctgggggcacagcggccctgggctgcctggtcaaggactacttcctagtacgtga

SEQ ID NO: 444447 - DNA, 313 bp, Homo sapiens
  misc_feature: HEFZJCU01DU6V8.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacg

SEQ ID NO: 444448 - DNA, 385 bp, Homo sapiens; identical to SEQ ID NO: 444438
  misc_feature: HEFZJCU01EZHS4.18.60.F05.1.454.heavy.3.raw

SEQ ID NO: 444449 - DNA, 386 bp, Homo sapiens
  misc_feature: HEFZJCU01ERBBV.27.46.E02.1.454.heavy.3.raw
agcgtcgtctcacgaccggtgctcgatttagactcatctacagggaagggactggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtgtgaaagtccaagggccggaatactactttgactactggggccagggaaccctggtcaccgtctcctcagcttccaccaagggcccatccgtcttccccctggcgccctgctccaggagcacctccgagagcacagccgccctgggctgcctggtcaaggactacttccagacgacgct

SEQ ID NO: 444450 - DNA, 379 bp, Homo sapiens
  misc_feature: HEFZJCU01C2HK7.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 444451 - DNA, 379 bp, Homo sapiens
  misc_feature: HEFZJCU01DTX3W.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatattgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgtctggtcaaggactacttcctacgtgagct

SEQ ID NO: 444452 - DNA, 400 bp, Homo sapiens
  misc_feature: HEFZJCU01CM05N.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 444453 - DNA, 313 bp, Homo sapiens; identical to SEQ ID NO: 444428
  misc_feature: HEFZJCU01B6M7Q.11.59.F04.1.454.heavy.3.raw

SEQ ID NO: 444454 - DNA, 384 bp, Homo sapiens
  misc_feature: HEFZJCU01D7Q9D.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 444455 - DNA, 306 bp, Homo sapiens
  misc_feature: HEFZJCU01CMWS0.49.38.D05.1.454.heavy.3.raw
agtcgagagacacgaccggtgctcgatttagtatctgatagttgggtttgggcacgaccggtgctcgatttagtatctgatagttgggttttggggggaagaggaagactgacggtcctcccaggagttcaggtgctgggcaccgtgggcatggggaggtgtgtcacaagatttgagccctggtcaccgtctcctcagcttccaccaagggcccatcggtcttccccctggcgccctgctccaggagcacctctggggcacagcggccctgggctgcctggtcaaggactacttcctctctcgact

SEQ ID NO: 444456 - DNA, 392 bp, Homo sapiens
  misc_feature: HEFZJCU01EWHYZ.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttccccctggcgccctgctccaggagcacctccgagagcacagcggccctgggctgcctggtcaaggactacttcctagagacacg

SEQ ID NO: 444457 - DNA, 379 bp, Homo sapiens; identical to SEQ ID NO: 444450
  misc_feature: HEFZJCU01D0FNW.47.77.G11.1.454.heavy.3.raw

SEQ ID NO: 444458 - DNA, 375 bp, Homo sapiens
  misc_feature: HEFZJCU01DOI7I.13.78.H01.1.454.heavy.3.raw
tcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttccgtactagacg

SEQ ID NO: 444459 - DNA, 375 bp, Homo sapiens
  misc_feature: HEFZJCU01EX2HF.48.59.F04.1.454.heavy.3.raw
agtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 444460 - DNA, 356 bp, Homo sapiens
  misc_feature: HEFZJCU01BZWZ1.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 444461 - DNA, 315 bp, Homo sapiens; identical to SEQ ID NO: 444422
  misc_feature: HEFZJCU01EDO8N.47.84.H07.1.454.heavy.3.raw

SEQ ID NO: 444462 - DNA, 315 bp, Homo sapiens; identical to SEQ ID NO: 444422
  misc_feature: HEFZJCU01AZT2P.47.84.H07.1.454.heavy.3.raw

SEQ ID NO: 444463 - DNA, 378 bp, Homo sapiens
  misc_feature: HEFZJCU01CDI44.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 444464 - DNA, 385 bp, Homo sapiens; identical to SEQ ID NO: 444438
  misc_feature: HEFZJCU01DT048.18.60.F05.1.454.heavy.3.raw

SEQ ID NO: 444465 - DNA, 313 bp, Homo sapiens
  misc_feature: HEFZJCU01AHOUR.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgactggtcaaggactacttcctagagacacg

SEQ ID NO: 444466 - DNA, 336 bp, Homo sapiens
  misc_feature: HEFZJCU01DV8RJ.19.74.G08.1.454.heavy.3.raw
tactctcgtgcacgaccggtgctcgatttagtagctctatcagggtcaggaaaaactggttcttcgactcgtcatatcaatggacaagtcgaagaaccagtttttcctgaccctgacctctttgagcgccgcggacacggccgtctattactgtgcgagagcgtggggaagcagtggccctgacaatgacttctggggccagggaatcctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 444467 - DNA, 423 bp, Homo sapiens
  misc_feature: HEFZJCU01EEZ9I.51.41.D08.1.454.heavy.3.raw
cgatcgtatacacgaccggtgctcgatttagtcacgcgagaaagggaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 444468 - DNA, 398 bp, Homo sapiens
  misc_feature: HEFZJCU01CN6C0.48.44.D11.1.454.heavy.3.raw
agtatacatacacgaccggtgctcgatttagcgcagtacgaaggggcgattcaccttctccagaggcaattccaagaacaccctgtgtcttcgtgggtctcatttctttatagcggtgttaggacaacctacgcagactccgtgaaggggcgattcgaccttctccagaggcaattccaagaacaccctgtatcttcaaactaaacagtctaagagccgaggacacggccctggtgttacggccggtgacggaaccggtggctagcggggccagggaaccctggctcagcctccaccaagggcccatcggtcttccccctggcaccctcctccaagagcacctctgggggcacagcggccctgggctgcctggtcaaggactacttcctatgtatact

SEQ ID NO: 444469 - DNA, 396 bp, Homo sapiens
  misc_feature: HEFZJCU01CD8JM.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 444470 - DNA, 378 bp, Homo sapiens
  misc_feature: HEFZJCU01C181H.48.66.F11.1.454.heavy.3.raw
agtatacatacacgaccggtgctcgatttagtcacgcgagaaggggctggtttgggtctcacgtatttatgctgctggagatacagcctacgcggactccgtgaagggccgattcaccatctctagagacaacgccaagaacacggtgactctgcaaatggacggtctgagggccgacgacacggctgtctactattgtgcaaaagggccgattaactcttacggtctggacgtctggggccaagggaccacggtcagcgtctcttcagcctccaccaagggcccatcggtcttccccctggcgccctgctccaggagcacctccgagagcacagcggccctgggctgcctggtcaaggactacttcctatgtatact

SEQ ID NO: 444471 - DNA, 503 bp, Homo sapiens
  misc_feature: HEFZJCU01DLOQ6.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggtgccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 444472 - DNA, 338 bp, Homo sapiens
  misc_feature: HEFZJCU01ENY4H.53.8.A08.1.454.heavy.3.raw
cgcgtatacacacgaccggtgctcgatttagcatactctacagggccgattcaccatctccagagacaattccaagaacaccctgtatctgcaattgagcagactcacagctgaggacacggctgtgtattactgtgtgaaagacgtttatgagagtagtggtttttccgagtacgcacattacggtatggacgtctggggccaagggaccccggtcaccgtctccttagcctccaccaagggcccatcggtcttccccctggcaccctcctccaagagcacctctggggcacagcggccctgggctgcctggtcaaggactacttcctcgtactgcg

SEQ ID NO: 444473 - DNA, 310 bp, Homo sapiens
  misc_feature: HEFZJCU01B7T2J.18.53.E09.1.454.heavy.3.raw
tacgagtatgcacgaccggtgctcgatttagagagagtgtgttgggttgggtgcccaagctgctggagggcacggtcaccacgctgctgagcagcctgagatctgaggacacggccgtgtattactgtgctagagagggacgtatagtgggagctccctttgacttctggggccagggaaccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 444474 - DNA, 380 bp, Homo sapiens
  misc_feature: HEFZJCU01CDPVH.10.35.D02.1.454.heavy.3.raw
catagtagtgcacgaccggtgctcgatttagcacacgatagttgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttccccctggcgccctgctccaggagcacctccgagagcacagcggccctgggctgcctggtcaaggactacttcccactactatg

SEQ ID NO: 444475 - DNA, 324 bp, Homo sapiens
  misc_feature: HEFZJCU01DAZ5W.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 444476 - DNA, 396 bp, Homo sapiens; identical to SEQ ID NO: 444426
  misc_feature: HEFZJCU01E0ZX7.18.31.C09.1.454.heavy.3.raw

SEQ ID NO: 444477 - DNA, 383 bp, Homo sapiens
  misc_feature: HEFZJCU01EXTSF.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctgggctgcctggtcaaggactacttcctacgtgagct

SEQ ID NO: 444478 - DNA, 311 bp, Homo sapiens
  misc_feature: HEFZJCU01BZX4I.49.8.A08.1.454.heavy.3.raw
agtcgagagacacgaccggtgctcgatttagcatactctacagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttcccctggcaccctcctccaagagcacctctggggcacagcggccctgggctgcctggtcaaggactacttcctctctcgact

SEQ ID NO: 444479 - DNA, 316 bp, Homo sapiens
  misc_feature: HEFZJCU01A7ONS.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 444480 - DNA, 400 bp, Homo sapiens; identical to SEQ ID NO: 444452
  misc_feature: HEFZJCU01B2AZ0.47.24.C02.1.454.heavy.3.raw

SEQ ID NO: 444481 - DNA, 339 bp, Homo sapiens; identical to SEQ ID NO: 444436
  misc_feature: HEFZJCU01DPEO1.47.38.D05.1.454.heavy.3.raw

SEQ ID NO: 444482 - DNA, 400 bp, Homo sapiens; identical to SEQ ID NO: 444452
  misc_feature: HEFZJCU01C5JV8.47.24.C02.1.454.heavy.3.raw

SEQ ID NO: 444483 - DNA, 395 bp, Homo sapiens
  misc_feature: HEFZJCU01DH64B.13.70.G04.1.454.heavy.3.raw
tcacgtactacacgaccggtgctcgatttagtgtagtgtgaagggaaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgatttttggagtggttataccgagtggggccagggaaccctggtcatcgtctcctcagcctccaccaagggcccatcggtcttccccctggcaccctcctccaagagcacctctggggcacagcggccctgggctgcctggtcaaggactacttcctagtacgtga

SEQ ID NO: 444484 - DNA, 317 bp, Homo sapiens
  misc_feature: HEFZJCU01BK6B6.13.66.F11.1.454.heavy.3.raw
tcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttccccctggcgccctgctccaggagcacctctgggggcacagcggccctgggctgcctggtcaaggactacttcctagtacgtga

SEQ ID NO: 444485 - DNA, 352 bp, Homo sapiens
  misc_feature: HEFZJCU01DB2PN.10.38.D05.1.454.heavy.3.raw
catagtagtgcacgaccggtgctcgatttagtatctgatagttgggtttggggggaagaggaagactgacggtcctgccacaggtggtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 444486 - DNA, 507 bp, Homo sapiens
  misc_feature: HEFZJCU01C3LVY.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccggg

SEQ ID NO: 444487 - DNA, 357 bp, Homo sapiens
  misc_feature: HEFZJCU01EKTFE.49.68.G02.1.454.heavy.3.raw
agtcgagagacacgaccggtgctcgatttagtcgatagtgaagggaaaggggttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggccccctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444488 - DNA, 335 bp, Homo sapiens
  misc_feature: HEFZJCU01CF3TT.51.45.E01.1.454.heavy.3.raw
cgatcgtatacacgaccggtgctcgatttagtgagtcagtaagggaaagggcccattcgccatctccagagacaattccaaaataccctctatctgcgaatgaacagcctgcgacctgaagacacggctatatatttctgtgcgagaggggagtcttattgtaatgatggttcctgctatcgttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 444489 - DNA, 315 bp, Homo sapiens
  misc_feature: HEFZJCU01DXQJ1.47.56.F01.1.454.heavy.3.raw
agctcacgtacacgaccggtgctcgatttagcagacgtctgtcgcagggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttcccctggcaccctcctccaagagcacctctgggggcacagcggccctgggctgcctggtcaaggactacttcctacgtgagct

SEQ ID NO: 444490 - DNA, 394 bp, Homo sapiens
  misc_feature: HEFZJCU01B1IY0.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggctacttcctacgtgagct

SEQ ID NO: 444491 - DNA, 396 bp, Homo sapiens; identical to SEQ ID NO: 444469
  misc_feature: HEFZJCU01ATVME.47.46.E02.1.454.heavy.3.raw

SEQ ID NO: 444492 - DNA, 384 bp, Homo sapiens
  misc_feature: HEFZJCU01B38RP.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccgggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 444493 - DNA, 392 bp, Homo sapiens; identical to SEQ ID NO: 444456
  misc_feature: HEFZJCU01EYLLK.7.60.F05.1.454.heavy.3.raw

SEQ ID NO: 444494 - DNA, 395 bp, Homo sapiens
  misc_feature: HEFZJCU01CSJLJ.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 444495 - DNA, 403 bp, Homo sapiens
  misc_feature: HEFZJCU01BNZ6G.53.77.G11.1.454.heavy.3.raw
cgcgtatacacacgaccggtgctcgatttagctagtcactcaagggaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccattttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 444496 - DNA, 327 bp, Homo sapiens
  misc_feature: HEFZJCU01E2EG5.19.85.H08.1.454.heavy.3.raw
tactctcgtgcacgaccggtgctcgatttagtatcactcagtcgcggggccggtttaccatctccagagacaatgccaagaagacgctctttctgcaattggacggcctgagagtcgaagacacggctatttattactgtgtgagagagggggcactggctggtcgggtcgatcttttgatttgtggggccaaggatcaagcgtctccgtctcttcagcctccaccaagggcccatcggtcttccccctggcaccctcctccaagagcacctctgggggcacagcggccctgggctgcctggtcaaggactacttcccacgagagta

SEQ ID NO: 444497 - DNA, 462 bp, Homo sapiens
  misc_feature: HEFZJCU01DRT5H.10.85.H08.1.454.heavy.3.raw
catagtagtgcacgaccggtgctcgatttagtatcactcagtcggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctccgagagcacagcggccctgggctgcctggtcaaggactacttcccactactatg

SEQ ID NO: 444498 - DNA, 316 bp, Homo sapiens; identical to SEQ ID NO: 444444
  misc_feature: HEFZJCU01A6PTC.47.56.F01.1.454.heavy.3.raw

SEQ ID NO: 444499 - DNA, 316 bp, Homo sapiens
  misc_feature: HEFZJCU01DKN86.13.71.G05.1.454.heavy.3.raw
tcacgtactacacgaccggtgctcgatttagtgtcgtcgcaagagagaggggggtgccagggggaagaccgatgggcccttggtgaaggcctcggacaccgccatgtattactgtgcaaaataacgcatactacggtaattcaccggcttactactacaacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 444500 - DNA, 490 bp, Homo sapiens
  misc_feature: HEFZJCU01BQ15R.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 444501 - DNA, 341 bp, Homo sapiens
  misc_feature: HEFZJCU01ECECZ.19.25.C03.1.454.heavy.3.raw
tactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 444502 - DNA, 374 bp, Homo sapiens
  misc_feature: HEFZJCU01DKT2X.9.14.B03.1.454.heavy.3.raw
tgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 444503 - DNA, 482 bp, Homo sapiens
  misc_feature: HEFZJCU01D75V5.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 444504 - DNA, 411 bp, Homo sapiens
  misc_feature: HEFZJCU01AC6ZO.13.61.F06.1.454.heavy.3.raw
tcacgtactacacgaccggtgctcgatttagctacgctctaagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttccccctggcgccctgctccaggagcacctctgggggcacagcggccctgggctgcctggtcaaggactacttcctagtacgtga

SEQ ID NO: 444505 - DNA, 366 bp, Homo sapiens
  misc_feature: HEFZJCU01CNMSP.11.20.B09.1.454.heavy.3.raw
cgagagataccacgaccggtgctcgatttagtgtagtgtgaagggactggagtggattggtcatatcgataccactggaaacaccaattacaacccctccctcaagagtcgagtcaccatatccctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 444506 - DNA, 430 bp, Homo sapiens
  misc_feature: HEFZJCU01CHHZ3.52.87.H10.1.454.heavy.3.raw
cgcagtacgacacgaccggtgctcgatttagcagtactgcgttgggttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccaggtgagtcatcaccacccccagcttccaccaagggcccatcggtcttccccctggcgccctgctccaggagcacctctgggggcacagcggccctgggctgcctggtcaaggactacttcctatacgatcg

SEQ ID NO: 444507 - DNA, 395 bp, Homo sapiens
  misc_feature: HEFZJCU01B8JLI.18.31.C09.1.454.heavy.3.raw
tacgagtatgcacgaccggtgctcgatttagacgtctcatcaaggaaggaagggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 444508 - DNA, 396 bp, Homo sapiens; identical to SEQ ID NO: 444426
  misc_feature: HEFZJCU01CP977.18.31.C09.1.454.heavy.3.raw

SEQ ID NO: 444509 - DNA, 393 bp, Homo sapiens
  misc_feature: HEFZJCU01D4XXH.49.46.E02.1.454.heavy.3.raw
agtcgagagacacgaccggtgctcgatttagactcatctacagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444510 - DNA, 336 bp, Homo sapiens
  misc_feature: HEFZJCU01CZ4PE.3.31.C09.1.454.heavy.3.raw
agacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 444511 - DNA, 504 bp, Homo sapiens
  misc_feature: HEFZJCU01DP3YW.51.59.F04.1.454.heavy.3.raw
cgatcgtatacacgaccggtgctcgatttagtacacacacttagggattgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccc

SEQ ID NO: 444512 - DNA, 395 bp, Homo sapiens
  misc_feature: HEFZJCU01EV77O.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactcttcccatactcgta

SEQ ID NO: 444513 - DNA, 372 bp, Homo sapiens
  misc_feature: HEFZJCU01EIPKV.5.23.C01.1.454.heavy.3.raw
atcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 444514 - DNA, 391 bp, Homo sapiens
  misc_feature: HEFZJCU01BQSLB.12.24.C02.1.454.heavy.3.raw
atacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtat

SEQ ID NO: 444515 - DNA, 327 bp, Homo sapiens; identical to SEQ ID NO: 444439
  misc_feature: HEFZJCU01CUZV0.40.20.B09.1.454.heavy.3.raw

SEQ ID NO: 444516 - DNA, 385 bp, Homo sapiens; identical to SEQ ID NO: 444438
  misc_feature: HEFZJCU01EPN1T.18.60.F05.1.454.heavy.3.raw

SEQ ID NO: 444517 - DNA, 395 bp, Homo sapiens
  misc_feature: HEFZJCU01APUE9.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 444518 - DNA, 313 bp, Homo sapiens
  misc_feature: HEFZJCU01BVCU7.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacg

SEQ ID NO: 444519 - DNA, 409 bp, Homo sapiens
  misc_feature: HEFZJCU01DKTNN.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 444520 - DNA, 385 bp, Homo sapiens
  misc_feature: HEFZJCU01BYC62.13.62.F07.1.454.heavy.3.raw
tcacgtactacacgaccggtgctcgatttagtagtcgcataaagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 444521 - DNA, 490 bp, Homo sapiens
  misc_feature: HEFZJCU01C7XMO.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactactcccacgagagta

SEQ ID NO: 444522 - DNA, 408 bp, Homo sapiens
  misc_feature: HEFZJCU01B2GSC.3.41.D08.1.454.heavy.3.raw
agacgcactccacgaccggtgctcgatttagtcacgcgagaaagggaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 444523 - DNA, 383 bp, Homo sapiens; identical to SEQ ID NO: 444477
  misc_feature: HEFZJCU01DFK2R.47.60.F05.1.454.heavy.3.raw

SEQ ID NO: 444524 - DNA, 398 bp, Homo sapiens
  misc_feature: HEFZJCU01AGYMA.7.60.F05.1.454.heavy.3.raw
cgtgtctctacacgaccggtgctcgatttagtacgtcatcaggctccagggaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttccccctggcgccctgctccaggagcacctccgagagcacagcggccctgggctgcctggtcaaggactacttcctagagacacg

SEQ ID NO: 444525 - DNA, 429 bp, Homo sapiens
  misc_feature: HEFZJCU01C4Z6U.53.65.F10.1.454.heavy.3.raw
cgcgtatacacacgaccggtgctcgatttagctacgctctaagggagtagagtcctgaggactgtaggctcccgggaaggggctggagtgggtctcaggtattagtggcagtggtggaatcacatactacgcagactccgtgaagggccggttcaccatctccagagacaactccaagaacacactgtttctacaaatgaatagcctgagagccgcggacacggccgtatattattgtgcgaaagtttgggggtgcaattggagtggtttttagatccgattgactactggggcctgggaaccctggtcaccgtctcctcagcctccaccaagggcccatcggtcttcccctggcaccctcctccaagagcacctctgggggcacagcggccctgggctgcctggtcaaggctacttcctcgtactgcg

SEQ ID NO: 444526 - DNA, 379 bp, Homo sapiens; identical to SEQ ID NO: 444450
  misc_feature: HEFZJCU01CW1M1.47.77.G11.1.454.heavy.3.raw

SEQ ID NO: 444527 - DNA, 516 bp, Homo sapiens
  misc_feature: HEFZJCU01EUKC2.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcgccctggctgcctggtcaaggactacttccagacgtatca

SEQ ID NO: 444528 - DNA, 357 bp, Homo sapiens
  misc_feature: HEFZJCU01BFDJ0.49.45.E01.1.454.heavy.3.raw
agtcgagagacacgaccggtgctcgatttagtgagtcagtaagggaaaggggttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggccccctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444529 - DNA, 500 bp, Homo sapiens
  misc_feature: HEFZJCU01DR9VJ.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 444530 - DNA, 400 bp, Homo sapiens; identical to SEQ ID NO: 444452
  misc_feature: HEFZJCU01CEVK2.47.24.C02.1.454.heavy.3.raw

SEQ ID NO: 444531 - DNA, 393 bp, Homo sapiens; identical to SEQ ID NO: 444509
  misc_feature: HEFZJCU01BHKTI.49.46.E02.1.454.heavy.3.raw

SEQ ID NO: 444532 - DNA, 483 bp, Homo sapiens
  misc_feature: HEFZJCU01DAV9M.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 444533 - DNA, 379 bp, Homo sapiens; identical to SEQ ID NO: 444450
  misc_feature: HEFZJCU01EWK7A.47.77.G11.1.454.heavy.3.raw

SEQ ID NO: 444534 - DNA, 397 bp, Homo sapiens
  misc_feature: HEFZJCU01EG8VE.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 444535 - DNA, 312 bp, Homo sapiens; identical to SEQ ID NO: 444415
  misc_feature: HEFZJCU01CY4F5.7.10.A10.1.454.heavy.3.raw

SEQ ID NO: 444536 - DNA, 378 bp, Homo sapiens
  misc_feature: HEFZJCU01BHXCY.19.17.B06.1.454.heavy.3.raw
tactctcgtgcacgaccggtgctcgatttagtcgatagtgaaggggctggaatggcttgcatcccttggttggagtggaattaatacacaccacgcagactcagtgaggggccggttcaccatctccagagacaacgccaagagtacaatgtatttacaaatgaacagcctgagagccgaggatacggctgtgtattattgtgcgagaatttccgagccgcactactttgactactggggccagggagccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 444537 - DNA, 399 bp, Homo sapiens
  misc_feature: HEFZJCU01BYW1R.16.29.C07.1.454.heavy.3.raw
tgtactactccacgaccggtgctcgatttagagtgctacgaagggaaaggggctggagtgggtctcagctattagtattagtggtgatagcacatactacgcagactccgtgaagggccggttcaccatctccagagacaattccaagaatatgttgtatctgcaaatgaacagcctgagagccgaggacacggccgtatattactgtgcgaaagatgtaaagtgggcgctactggactcgggggcttttgatatctggggccaagggacaatggtcaccgtctcttcagcctccaccaagggcccatcggtcttccccctggcaccctcctccaagagcacctctgggggcacagcggccctgggctgcctggtcaaggactacttccgagtagtaca

SEQ ID NO: 444538 - DNA, 313 bp, Homo sapiens
  misc_feature: HEFZJCU01DR7E6.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaaccaagggcccatcggtcttcccctggcaccctcctccaagagcacctctggggcacagcggccctgggctgcctggtcaaggactacttcctagagacacg

SEQ ID NO: 444539 - DNA, 468 bp, Homo sapiens
  misc_feature: HEFZJCU01BVWRZ.4.10.A10.1.454.heavy.3.raw
agcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccggtggtgctgagaaacggcgttgacttctggggccagggaaccctggtcaccgtctcctcagcctccaccaagggcccatcggtcttccccctggcgccctgctccaggagcacctccgagagcacagcggccctgggctgcctggtcaaggactacttccttacagtgct

SEQ ID NO: 444540 - DNA, 403 bp, Homo sapiens
  misc_feature: HEFZJCU01EZKU4.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 444541 - DNA, 390 bp, Homo sapiens
  misc_feature: HEFZJCU01BY5WF.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 444542 - DNA, 379 bp, Homo sapiens; identical to SEQ ID NO: 444450
  misc_feature: HEFZJCU01A7QLD.47.77.G11.1.454.heavy.3.raw

SEQ ID NO: 444543 - DNA, 381 bp, Homo sapiens
  misc_feature: HEFZJCU01DRW7I.9.53.E09.1.454.heavy.3.raw
tgatacgtctcacgaccggtgctcgatttagagagagtgtgttggggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaacgggcccatcggtcttcccctggcgccctgctccaggagcacctccgagagcacagcggccctgggctgcctggtcaaggactacttccagacgtatca

SEQ ID NO: 444544 - DNA, 329 bp, Homo sapiens
  misc_feature: HEFZJCU01DNXH3.53.44.D11.1.454.heavy.3.raw
cgcgtatacacacgaccggtgctcgatttagcgcagtacgaagggccggttcatcatgtccagagacaactccaagaacacactgtatctgcaaatgaacagcctaagagccgaggacacggccgtatattactgtgcgaagatttggggtggcaactggagtggtttttagatccgattgactcctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 444545 - DNA, 313 bp, Homo sapiens; identical to SEQ ID NO: 444447
  misc_feature: HEFZJCU01E0Z5M.7.10.A10.1.454.heavy.3.raw

SEQ ID NO: 444546 - DNA, 412 bp, Homo sapiens
  misc_feature: HEFZJCU01EQR9E.13.30.C08.1.454.heavy.3.raw
tcacgtactacacgaccggtgctcgatttagtctgacgtcaaagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttccccctggcgccctgctccaggagcacctctgggggcacagcggccctgggctgcctggtcaaggactacttccgtactagacg

SEQ ID NO: 444547 - DNA, 310 bp, Homo sapiens
  misc_feature: HEFZJCU01CJ9PC.18.53.E09.1.454.heavy.3.raw
tacgagtatgcacgaccggtgctcgatttagagagagtgtgttgggttgggtgcccaagctgctggagggcacggtcaccacgctgctgagcagcctgagatctgaggacacggccgtgtattactgtgctagagagggacgtatagtgggagctccctttgacttctggggccagggaaccctggtcaccgtctcctcagcttccaccaagggcccatcggtcttcccctggcgccctgctccaggagcacctctgggggcacagtcggccctgggctgcctggtcaaggactacttcccatactcgta

SEQ ID NO: 444548 - DNA, 378 bp, Homo sapiens; identical to SEQ ID NO: 444463
  misc_feature: HEFZJCU01CSAMQ.47.77.G11.1.454.heavy.3.raw

SEQ ID NO: 444549 - DNA, 379 bp, Homo sapiens
  misc_feature: HEFZJCU01DX0X4.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctccgagagcacagcggccctgggctgcctggtcaaggactacttcctacgtgagct

SEQ ID NO: 444550 - DNA, 403 bp, Homo sapiens; identical to SEQ ID NO: 444540
  misc_feature: HEFZJCU01C2M4R.16.72.G06.1.454.heavy.3.raw

SEQ ID NO: 444551 - DNA, 316 bp, Homo sapiens; identical to SEQ ID NO: 444444
  misc_feature: HEFZJCU01C7NKS.47.56.F01.1.454.heavy.3.raw

SEQ ID NO: 444552 - DNA, 386 bp, Homo sapiens
  misc_feature: HEFZJCU01DEKLG.11.20.B09.1.454.heavy.3.raw
cgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccctgggctgcctggtcaaggactattccgtatctctcg

SEQ ID NO: 444553 - DNA, 338 bp, Homo sapiens
  misc_feature: HEFZJCU01C220P.14.28.C06.1.454.heavy.3.raw
cgtctagtaccacgaccggtgctcgatttagagctcacgtattgggtttgggtgccgaagttgtctggaggtcacggtcaccacgctgctgagggagtagagtcctgaggtctgtgaccgctcgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 444554 - DNA, 418 bp, Homo sapiens
  misc_feature: HEFZJCU01BK6I2.11.37.D04.1.454.heavy.3.raw
cgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggccaaatattattgtgtcagagacaagactcaattttgtgttcgtggtcactgctggttcgacccctggggccagggaaccctgatcaccgtctcctctgcctccaccaagggcccatcggtcttcccctggcaccctcctccaagagcacctctgggggcacagcggccctgggctgcctggtcaaggactacttccgtatctctcg

SEQ ID NO: 444555 - DNA, 482 bp, Homo sapiens; identical to SEQ ID NO: 444503
  misc_feature: HEFZJCU01C1VEL.7.10.A10.1.454.heavy.3.raw

SEQ ID NO: 444556 - DNA, 384 bp, Homo sapiens
  misc_feature: HEFZJCU01CKZ1Q.22.46.E02.1.454.heavy.3.raw
acatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccacgcgtatgt

SEQ ID NO: 444557 - DNA, 503 bp, Homo sapiens
  misc_feature: HEFZJCU01DH6EW.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 444558 - DNA, 397 bp, Homo sapiens
  misc_feature: HEFZJCU01EJ3TF.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagtttccaccaagggcccatcggtcttccccctggcgccctgctccaggagcacctctgggggcacagcggccctgggctgcctggtcaaggactacttcccatactcgta

SEQ ID NO: 444559 - DNA, 356 bp, Homo sapiens
  misc_feature: HEFZJCU01CVEFH.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctgatcaaggactacttcctacgtgagct

SEQ ID NO: 444560 - DNA, 504 bp, Homo sapiens
  misc_feature: HEFZJCU01DS8GC.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcagtcttcccctggcgccctgctccaggagcacctccgagagcacagcggccctgggctgcctggtcaaggactacttccagacgtatca

SEQ ID NO: 444561 - DNA, 394 bp, Homo sapiens
  misc_feature: HEFZJCU01DRN1H.48.60.F05.1.454.heavy.3.raw
agtatacatacacgaccggtgctcgatttagtacgtcatcagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 444562 - DNA, 379 bp, Homo sapiens; identical to SEQ ID NO: 444450
  misc_feature: HEFZJCU01EH3YP.47.77.G11.1.454.heavy.3.raw

SEQ ID NO: 444563 - DNA, 506 bp, Homo sapiens
  misc_feature: HEFZJCU01EMKSM.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaacgggcccatcggtcttcccctggcaccctcctccaagagcacctctgggggcacagcggccctgggctgcctggtcaaggactacttcctacgtcgtat

SEQ ID NO: 444564 - DNA, 426 bp, Homo sapiens
  misc_feature: HEFZJCU01B5XON.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 444565 - DNA, 395 bp, Homo sapiens; identical to SEQ ID NO: 444517
  misc_feature: HEFZJCU01DSHRY.16.68.G02.1.454.heavy.3.raw

SEQ ID NO: 444566 - DNA, 395 bp, Homo sapiens
  misc_feature: HEFZJCU01C35MS.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataacttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 444567 - DNA, 380 bp, Homo sapiens
  misc_feature: HEFZJCU01CYLVX.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctcctgggggcacagcggccctgggctgcctggtcaaggactacttcctacgtgagct

SEQ ID NO: 444568 - DNA, 396 bp, Homo sapiens
  misc_feature: HEFZJCU01BUKSO.47.46.E02.1.454.heavy.3.raw
agctcacgtacacgaccggtgctcgatttagactcatctacaggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 444569 - DNA, 356 bp, Homo sapiens; identical to SEQ ID NO: 444460
  misc_feature: HEFZJCU01CFDOD.47.38.D05.1.454.heavy.3.raw

SEQ ID NO: 444570 - DNA, 330 bp, Homo sapiens
  misc_feature: HEFZJCU01CCF04.48.41.D08.1.454.heavy.3.raw
agtatacatacacgaccggtgctcgatttagtcacgcgagaaagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 444571 - DNA, 396 bp, Homo sapiens; identical to SEQ ID NO: 444433
  misc_feature: HEFZJCU01EXJNU.47.59.F04.1.454.heavy.3.raw

SEQ ID NO: 444572 - DNA, 395 bp, Homo sapiens; identical to SEQ ID NO: 444517
  misc_feature: HEFZJCU01EZAXU.16.68.G02.1.454.heavy.3.raw

SEQ ID NO: 444573 - DNA, 396 bp, Homo sapiens; identical to SEQ ID NO: 444469
  misc_feature: HEFZJCU01EDDI0.47.46.E02.1.454.heavy.3.raw

SEQ ID NO: 444574 - DNA, 396 bp, Homo sapiens
  misc_feature: HEFZJCU01E1EY4.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctctgggggcacagcggccctgggctgcctggtcaaggactacttcctacgtgagct

SEQ ID NO: 444575 - DNA, 324 bp, Homo sapiens; identical to SEQ ID NO: 444475
  misc_feature: HEFZJCU01EDP64.18.17.B06.1.454.heavy.3.raw

SEQ ID NO: 444576 - DNA, 313 bp, Homo sapiens; identical to SEQ ID NO: 444518
  misc_feature: HEFZJCU01DU3XS.7.10.A10.1.454.heavy.3.raw

SEQ ID NO: 444577 - DNA, 372 bp, Homo sapiens
  misc_feature: HEFZJCU01BN9G4.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttcccctggcgccctgctccaggagcacctccgagagcacagcggccctgggctgcctggtcaaggactacttcctagagcacg

SEQ ID NO: 444578 - DNA, 372 bp, Homo sapiens
  misc_feature: HEFZJCU01AJCVB.49.68.G02.1.454.heavy.3.raw
agtcgagagacacgaccggtgctcgatttagtcgatagtgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 444579 - DNA, 395 bp, Homo sapiens
  misc_feature: HEFZJCU01DVGQ8.47.59.F04.1.454.heavy.3.raw
agctcacgtacacgaccggtgctcgatttagtacacacacttagggaggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 444580 - DNA, 338 bp, Homo sapiens; identical to SEQ ID NO: 444423
  misc_feature: HEFZJCU01C5Y1Q.47.38.D05.1.454.heavy.3.raw

SEQ ID NO: 444581 - DNA, 339 bp, Homo sapiens; identical to SEQ ID NO: 444436
  misc_feature: HEFZJCU01ER3F7.47.38.D05.1.454.heavy.3.raw

SEQ ID NO: 444582 - DNA, 315 bp, Homo sapiens; identical to SEQ ID NO: 444422
  misc_feature: HEFZJCU01ANW1H.47.84.H07.1.454.heavy.3.raw

SEQ ID NO: 444583 - DNA, 356 bp, Homo sapiens; identical to SEQ ID NO: 444460
  misc_feature: HEFZJCU01AFT23.47.38.D05.1.454.heavy.3.raw

SEQ ID NO: 444584 - DNA, 402 bp, Homo sapiens
  misc_feature: HEFZJCU01CTGCI.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 444585 - DNA, 309 bp, Homo sapiens; identical to SEQ ID NO: 444418
  misc_feature: HEFZJCU01DRO7K.18.53.E09.1.454.heavy.3.raw

SEQ ID NO: 444586 - DNA, 509 bp, Homo sapiens
  misc_feature: HEFZJCU01CGL4H.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 444587 - DNA, 391 bp, Homo sapiens; identical to SEQ ID NO: 444514
  misc_feature: HEFZJCU01DXMOX.12.24.C02.1.454.heavy.3.raw

SEQ ID NO: 444588 - DNA, 395 bp, Homo sapiens; identical to SEQ ID NO: 444579
  misc_feature: HEFZJCU01BIGBA.47.59.F04.1.454.heavy.3.raw

SEQ ID NO: 444589 - DNA, 449 bp, Homo sapiens
  misc_feature: HEFZJCU01EUAI9.53.57.F02.1.454.heavy.3.raw
cgcgtatacacacgaccggtgctcgatttagctcgatatagttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 444590 - DNA, 400 bp, Homo sapiens; identical to SEQ ID NO: 444452
  misc_feature: HEFZJCU01CDW44.47.24.C02.1.454.heavy.3.raw

SEQ ID NO: 444591 - DNA, 489 bp, Homo sapiens
  misc_feature: HEFZJCU01AJ1F6.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttcccatactcgta

SEQ ID NO: 444592 - DNA, 491 bp, Homo sapiens
  misc_feature: HEFZJCU01DWK20.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 444593 - DNA, 375 bp, Homo sapiens; identical to SEQ ID NO: 444459
  misc_feature: HEFZJCU01DH98C.48.59.F04.1.454.heavy.3.raw

SEQ ID NO: 444594 - DNA, 394 bp, Homo sapiens
  misc_feature: HEFZJCU01D4XRA.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 444595 - DNA, 316 bp, Homo sapiens
  misc_feature: HEFZJCU01CMPQC.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttggactactggggccagggaaccctggtcaccgtctcctcagcctccaccaagggcccatcggtcttccccctggcaccctcctccaagagcacctctggggcacagcggccctgggctgcctggtcaaggactacttcctacgtgagct

SEQ ID NO: 444596 - DNA, 377 bp, Homo sapiens
  misc_feature: HEFZJCU01DDMOQ.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 444597 - DNA, 499 bp, Homo sapiens
  misc_feature: HEFZJCU01DDP4U.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtctccccctggcgccctgctccaggagcacctccgagagcacagcggccctgggctgcctggtcaaggactactccga

SEQ ID NO: 444598 - DNA, 395 bp, Homo sapiens; identical to SEQ ID NO: 444494
  misc_feature: HEFZJCU01BNC97.47.46.E02.1.454.heavy.3.raw

SEQ ID NO: 444599 - DNA, 379 bp, Homo sapiens; identical to SEQ ID NO: 444450
  misc_feature: HEFZJCU01D08KT.47.77.G11.1.454.heavy.3.raw

SEQ ID NO: 444600 - DNA, 401 bp, Homo sapiens
  misc_feature: HEFZJCU01DYW4G.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagccacctccgagagcacagcggccctgggctgcctggtcaaggactacttcctacgtgagct

SEQ ID NO: 444601 - DNA, 398 bp, Homo sapiens
  misc_feature: HEFZJCU01AZK42.4.79.H02.1.454.heavy.3.raw
agcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttccccctggcgccctgctccaggagcacctccgagagcacagcggccctgggctgcctggtcaaggactacttccctacagtgct

SEQ ID NO: 444602 - DNA, 385 bp, Homo sapiens; identical to SEQ ID NO: 444438
  misc_feature: HEFZJCU01C57PB.18.60.F05.1.454.heavy.3.raw

SEQ ID NO: 444603 - DNA, 437 bp, Homo sapiens
  misc_feature: HEFZJCU01CJB64.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 444604 - DNA, 400 bp, Homo sapiens; identical to SEQ ID NO: 444452
  misc_feature: HEFZJCU01BLSCR.47.24.C02.1.454.heavy.3.raw

SEQ ID NO: 444605 - DNA, 476 bp, Homo sapiens
  misc_feature: HEFZJCU01DAP36.12.81.H04.1.454.heavy.3.raw
atacgacgtacacgaccggtgctcgatttagtagtgtagattcgcgggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaacccttgtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 444606 - DNA, 396 bp, Homo sapiens; identical to SEQ ID NO: 444469
  misc_feature: HEFZJCU01COE77.47.46.E02.1.454.heavy.3.raw

SEQ ID NO: 444607 - DNA, 510 bp, Homo sapiens
  misc_feature: HEFZJCU01A05VK.48.34.D01.1.454.heavy.3.raw
agtatacatacacgaccggtgctcgatttagatcgtctgtgttgggtcgggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 444608 - DNA, 375 bp, Homo sapiens; identical to SEQ ID NO: 444459
  misc_feature: HEFZJCU01B9N03.48.59.F04.1.454.heavy.3.raw

SEQ ID NO: 444609 - DNA, 409 bp, Homo sapiens
  misc_feature: HEFZJCU01DLCL3.9.11.A11.1.454.heavy.3.raw
tgatacgtctcacgaccggtgctcgatttagctacgactgcagggaagggcctggagtacattggggacatctatgccactgggagcaccgactacaacccgtccctcgagagtcgactctccatgtcccttgacacgtctaagaaccagtattccctgcaactgagctccgtgactgccgctgacacggccgtttattactgtgccataacagcctgtattactaccagttgctatcatctgagtccggacagctactttgtctcctggggcctgggaaccctggtcaccgtctcctcagcctccaccaagggcccatcggtcttccccctggcaccctcctccaagagcacctctggggcacagcggccctgggctgcctggtcaaggactacttccagacgtatca

SEQ ID NO: 444610 - DNA, 499 bp, Homo sapiens
  misc_feature: HEFZJCU01ECKAN.15.70.G04.1.454.heavy.3.raw
tctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtgggggcaccaactacaacccctccctcaagagtcgagtcatcatttcagtagacacgtccaagaaccagttctccctgaagatgagctctgtgaccgccgctgacacggccgtctattattgtgcgagacatcggcacctaagttggttcgacccctggggccagggaacccgggtcaccgtcgcctcagcctccaccaagggcccatcggtcttccccctggcaccctcctccaagagcacctctgggggcacagcggccctgggctgcctggtcaaggactacttccgctacgtaga

SEQ ID NO: 444611 - DNA, 505 bp, Homo sapiens
  misc_feature: HEFZJCU01AJOIO.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgctcctcagcctccaccaagggcccatcggtcttcccctggcaccctcctccaagagcacctctgggggcacagcggccctgggctgcctggtcaaggactacttccgagtagtaca

SEQ ID NO: 444612 - DNA, 379 bp, Homo sapiens; identical to SEQ ID NO: 444450
  misc_feature: HEFZJCU01C0YSN.47.77.G11.1.454.heavy.3.raw

SEQ ID NO: 444613 - DNA, 316 bp, Homo sapiens; identical to SEQ ID NO: 444479
  misc_feature: HEFZJCU01EXTOD.47.84.H07.1.454.heavy.3.raw

SEQ ID NO: 444614 - DNA, 391 bp, Homo sapiens
  misc_feature: HEFZJCU01DRA1Y.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 444615 - DNA, 495 bp, Homo sapiens
  misc_feature: HEFZJCU01A6O39.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactac

SEQ ID NO: 444616 - DNA, 396 bp, Homo sapiens; identical to SEQ ID NO: 444469
  misc_feature: HEFZJCU01EXPLR.47.46.E02.1.454.heavy.3.raw

SEQ ID NO: 444617 - DNA, 488 bp, Homo sapiens
  misc_feature: HEFZJCU01ECA6E.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggccctgggctgcctggtcaaggactacttccctacagtgct

SEQ ID NO: 444618 - DNA, 495 bp, Homo sapiens
  misc_feature: HEFZJCU01ECEC6.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggccctgggctgcctggtcaaggactac

SEQ ID NO: 444619 - DNA, 508 bp, Homo sapiens
  misc_feature: HEFZJCU01BP9C6.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 444620 - DNA, 337 bp, Homo sapiens
  misc_feature: HEFZJCU01CRUJ4.49.79.H02.1.454.heavy.3.raw
agtcgagagacacgaccggtgctcgatttagtgtcacacgaagggaaagggccgattcatcatctccagagacaactccgagaacacgctgtatctgcaaatgaacaggctgagagctgaagacacggctttatattactgtgcgaacttaatcacggaggacaacggtgaccccgtccgctcggtgcggaggtctggggccaagggaccacggtcatcgtctcctcagcctccaccaagggcccatcggtcttccccctggcaccctcctccaagagcacctctggggcacagcggccctgggctgcctggtcaaggactacttcctctctcgact

SEQ ID NO: 444621 - DNA, 407 bp, Homo sapiens
  misc_feature: HEFZJCU01AG5G3.40.22.B11.1.454.heavy.3.raw
tctagcgactcacgaccggtgctcgatttagacgacagctcagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctacaattggagatactactactactacggtatggacgtctggggccaagggaccacggtctccgtctcctcagcttccaccaagggcccatcggtcttccccctggcgccctgctccaggagcacctctgggggcacagcggccctgggctgcctggtcaaggactacttccagtcgctaga

SEQ ID NO: 444622 - DNA, 338 bp, Homo sapiens
  misc_feature: HEFZJCU01EE8D2.11.26.C04.1.454.heavy.3.raw
cgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctcctagagcacagcggccctgggctgcctggtcaaggactacttccgtatctctcg

SEQ ID NO: 444623 - DNA, 470 bp, Homo sapiens
  misc_feature: HEFZJCU01CL9CR.15.1.A01.1.454.heavy.3.raw
tctacgtagccacgaccggtgctcgatttagacgtctcatcaggggtccctgagactctcatgtgcaggctctagattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttcccctggcaccctcctccaagagcacctctgggggcacagcggccctgggctgcctggtcaaggactacttccgctacgtaga

SEQ ID NO: 444624 - DNA, 379 bp, Homo sapiens
  misc_feature: HEFZJCU01ADS05.47.62.F07.1.454.heavy.3.raw
agctcacgtacacgaccggtgctcgatttagtagtcgcataaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 444625 - DNA, 401 bp, Homo sapiens
  misc_feature: HEFZJCU01C614Y.4.77.G11.1.454.heavy.3.raw
agcactgtagcacgaccggtgctcgatttagctagtcactcaagggaaaggggctggaatggctttcattacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctccgagagcacagcggccctgggctgcctggtcaaggactacttccctacagtgct

SEQ ID NO: 444626 - DNA, 392 bp, Homo sapiens
  misc_feature: HEFZJCU01EZNAD.49.46.E02.1.454.heavy.3.raw
agtcgagagacacgaccggtgctcgatttagactcatctacagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444627 - DNA, 400 bp, Homo sapiens; identical to SEQ ID NO: 444452
  misc_feature: HEFZJCU01B83V8.47.24.C02.1.454.heavy.3.raw

SEQ ID NO: 444628 - DNA, 515 bp, Homo sapiens
  misc_feature: HEFZJCU01DRLG2.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctgcgcctgctcagagcacctccgagagcacagcggccctggctgcctggtcaaggactactcctacg

SEQ ID NO: 444629 - DNA, 317 bp, Homo sapiens
  misc_feature: HEFZJCU01CEOHE.47.56.F01.1.454.heavy.3.raw
agctcacgtacacgaccggtgctcgatttagcagacgtctgtcgcagggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaaggactacttccctacgtgagct

SEQ ID NO: 444630 - DNA, 313 bp, Homo sapiens; identical to SEQ ID NO: 444428
  misc_feature: HEFZJCU01DB235.11.59.F04.1.454.heavy.3.raw

SEQ ID NO: 444631 - DNA, 509 bp, Homo sapiens; identical to SEQ ID NO: 444586
  misc_feature: HEFZJCU01DDVY8.12.78.H01.1.454.heavy.3.raw

SEQ ID NO: 444632 - DNA, 379 bp, Homo sapiens; identical to SEQ ID NO: 444450
  misc_feature: HEFZJCU01CK9C4.47.77.G11.1.454.heavy.3.raw

SEQ ID NO: 444633 - DNA, 375 bp, Homo sapiens; identical to SEQ ID NO: 444459
  misc_feature: HEFZJCU01CSGBR.48.59.F04.1.454.heavy.3.raw

SEQ ID NO: 444634 - DNA, 316 bp, Homo sapiens; identical to SEQ ID NO: 444479
  misc_feature: HEFZJCU01CEL4Z.47.84.H07.1.454.heavy.3.raw

SEQ ID NO: 444635 - DNA, 387 bp, Homo sapiens
  misc_feature: HEFZJCU01DEKYV.11.27.C05.1.454.heavy.3.raw
cgagagataccacgaccggtgctcgatttagacgcgatcgaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatgcttttgatttctggggccaagggacaatgctcaccgtctcttcagcctccaccaagggcccatcggtcttccccctggcaccctcctccaagagcacctctgggggcacagcggccctgggctgcctggtcaaggactacttccgtatctctcg

SEQ ID NO: 444636 - DNA, 468 bp, Homo sapiens
  misc_feature: HEFZJCU01DTPBS.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactactcctacagtgct

SEQ ID NO: 444637 - DNA, 400 bp, Homo sapiens; identical to SEQ ID NO: 444452
  misc_feature: HEFZJCU01CKKIC.47.24.C02.1.454.heavy.3.raw

SEQ ID NO: 444638 - DNA, 384 bp, Homo sapiens
  misc_feature: HEFZJCU01DL4PS.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatttctcg

SEQ ID NO: 444639 - DNA, 483 bp, Homo sapiens
  misc_feature: HEFZJCU01EUER1.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 444640 - DNA, 374 bp, Homo sapiens
  misc_feature: HEFZJCU01CN6X8.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttccccctggcgccctgctccaggagcacctccgagagcacagcggccctgggctgcctggtcaaggactacttcctagagacacg

SEQ ID NO: 444641 - DNA, 378 bp, Homo sapiens; identical to SEQ ID NO: 444419
  misc_feature: HEFZJCU01ASTOE.47.77.G11.1.454.heavy.3.raw

SEQ ID NO: 444642 - DNA, 379 bp, Homo sapiens; identical to SEQ ID NO: 444450
  misc_feature: HEFZJCU01BWSZE.47.77.G11.1.454.heavy.3.raw

SEQ ID NO: 444643 - DNA, 391 bp, Homo sapiens; identical to SEQ ID NO: 444514
  misc_feature: HEFZJCU01C0MVG.12.24.C02.1.454.heavy.3.raw

SEQ ID NO: 444644 - DNA, 380 bp, Homo sapiens
  misc_feature: HEFZJCU01BYF81.9.53.E09.1.454.heavy.3.raw
tgatacgtctcacgaccggtgctcgatttagagagagtgtgttgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 444645 - DNA, 483 bp, Homo sapiens; identical to SEQ ID NO: 444532
  misc_feature: HEFZJCU01ERBJB.47.59.F04.1.454.heavy.3.raw

SEQ ID NO: 444646 - DNA, 379 bp, Homo sapiens
  misc_feature: HEFZJCU01D38XG.9.11.A11.1.454.heavy.3.raw
tgatacgtctcacgaccggtgctcgatttagctacgactgcagggaatactggttcttagacgtgtcaagggacatggagagtcgactctccatgtcccttgacacgtctaagaaccagtattccctgcaactgagctccgtgactgccgctgacacggccgtttattactgtgccataacagcctgtattactaccagttgctatcatctgagtccggacagctactttgtctcctggggcctgggaaccctggtcaccgtctcctcagcctccaccaagggcccatcggtcttccccctggcaccctcctccaagagcacctctgggggcacagcggccctgggctgcctggtcaaggactacttccagacgtatca

SEQ ID NO: 444647 - DNA, 374 bp, Homo sapiens; identical to SEQ ID NO: 444640
  misc_feature: HEFZJCU01BR0W7.7.37.D04.1.454.heavy.3.raw

SEQ ID NO: 444648 - DNA, 381 bp, Homo sapiens
  misc_feature: HEFZJCU01CQWKL.9.53.E09.1.454.heavy.3.raw
tgatacgtctcacgaccggtgctcgatttagagagagtgtgttggggttgggcgtatttttagcagtagggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 444649 - DNA, 426 bp, Homo sapiens
  misc_feature: HEFZJCU01ETMCF.11.26.C04.1.454.heavy.3.raw
cgagagataccacgaccggtgctcgatttagtctagcgactttgggtttggggggaagaggaagactgacggtccgccaggctccagggaaggggctggagtgggtggccaacataaagccagatggaggtgtaaacagtatgtagactctgtggagggccggttcaccatctccagagacaacgccaagaatgcgatatatctacagatgaacagcctgcgagccgaggacacggatgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 444650 - DNA, 481 bp, Homo sapiens
  misc_feature: HEFZJCU01C2WWJ.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctggggcacagcggccctgggctgcctggtcaaggactacttcctagagacacg

SEQ ID NO: 444651 - DNA, 488 bp, Homo sapiens
  misc_feature: HEFZJCU01DQP2V.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtagagatggctacaaaatctttctccgaattgacttctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 444652 - DNA, 396 bp, Homo sapiens; identical to SEQ ID NO: 444469
  misc_feature: HEFZJCU01DDGDJ.47.46.E02.1.454.heavy.3.raw

SEQ ID NO: 444653 - DNA, 324 bp, Homo sapiens; identical to SEQ ID NO: 444475
  misc_feature: HEFZJCU01BNMVV.18.17.B06.1.454.heavy.3.raw

SEQ ID NO: 444654 - DNA, 390 bp, Homo sapiens
  misc_feature: HEFZJCU01EEIO6.16.17.B06.1.454.heavy.3.raw
tgtactactccacgaccggtgctcgatttagtcgatagtgaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 444655 - DNA, 437 bp, Homo sapiens; identical to SEQ ID NO: 444603
  misc_feature: HEFZJCU01ETCLI.3.21.B10.1.454.heavy.3.raw

SEQ ID NO: 444656 - DNA, 502 bp, Homo sapiens
  misc_feature: HEFZJCU01AYC53.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactgggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 444657 - DNA, 480 bp, Homo sapiens
  misc_feature: HEFZJCU01B4D9X.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 444658 - DNA, 403 bp, Homo sapiens
  misc_feature: HEFZJCU01BQVM4.14.60.F05.1.454.heavy.3.raw
cgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgacccctggggccagggaaccctggtcaccgtctcctcagcttccaccaagggcccatcggtcttccccctggcgccctgctccaggagcacctctgggggcacagcggccctgggctgcctggtcaaggactacttccgtactagacg

SEQ ID NO: 444659 - DNA, 477 bp, Homo sapiens
  misc_feature: HEFZJCU01BQJIT.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444660 - DNA, 436 bp, Homo sapiens
  misc_feature: HEFZJCU01EF2MW.40.27.C05.1.454.heavy.3.raw
tctagcgactcacgaccggtgctcgatttagacgcgatcgaagagtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 444661 - DNA, 375 bp, Homo sapiens; identical to SEQ ID NO: 444442
  misc_feature: HEFZJCU01DDJB5.48.23.C01.1.454.heavy.3.raw

SEQ ID NO: 444662 - DNA, 396 bp, Homo sapiens; identical to SEQ ID NO: 444469
  misc_feature: HEFZJCU01DOBUT.47.46.E02.1.454.heavy.3.raw

SEQ ID NO: 444663 - DNA, 396 bp, Homo sapiens; identical to SEQ ID NO: 444469
  misc_feature: HEFZJCU01D9HG6.47.46.E02.1.454.heavy.3.raw

SEQ ID NO: 444664 - DNA, 336 bp, Homo sapiens; identical to SEQ ID NO: 444510
  misc_feature: HEFZJCU01CRHBR.3.31.C09.1.454.heavy.3.raw

SEQ ID NO: 444665 - DNA, 373 bp, Homo sapiens
  misc_feature: HEFZJCU01CXBIJ.49.62.F07.1.454.heavy.3.raw
agtcgagagacacgaccggtgctcgatttagtagtcgcataaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 444666 - DNA, 385 bp, Homo sapiens; identical to SEQ ID NO: 444438
  misc_feature: HEFZJCU01EXD5A.18.60.F05.1.454.heavy.3.raw

SEQ ID NO: 444667 - DNA, 399 bp, Homo sapiens; identical to SEQ ID NO: 444537
  misc_feature: HEFZJCU01C3C53.16.29.C07.1.454.heavy.3.raw

SEQ ID NO: 444668 - DNA, 483 bp, Homo sapiens; identical to SEQ ID NO: 444639
  misc_feature: HEFZJCU01BVI08.11.23.C01.1.454.heavy.3.raw

SEQ ID NO: 444669 - DNA, 489 bp, Homo sapiens; identical to SEQ ID NO: 444591
  misc_feature: HEFZJCU01ET0Q8.18.70.G04.1.454.heavy.3.raw

SEQ ID NO: 444670 - DNA, 478 bp, Homo sapiens
  misc_feature: HEFZJCU01DS5IN.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444671 - DNA, 338 bp, Homo sapiens; identical to SEQ ID NO: 444423
  misc_feature: HEFZJCU01CGFK9.47.38.D05.1.454.heavy.3.raw

SEQ ID NO: 444672 - DNA, 392 bp, Homo sapiens; identical to SEQ ID NO: 444456
  misc_feature: HEFZJCU01C998F.7.60.F05.1.454.heavy.3.raw

SEQ ID NO: 444673 - DNA, 383 bp, Homo sapiens
  misc_feature: HEFZJCU01EIYJD.11.61.F06.1.454.heavy.3.raw
cgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 444674 - DNA, 506 bp, Homo sapiens
  misc_feature: HEFZJCU01D5DGC.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcggccctgggctgcctggtcaaggactacttcctacgtcgtat

SEQ ID NO: 444675 - DNA, 430 bp, Homo sapiens
  misc_feature: HEFZJCU01CXN84.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctaga

SEQ ID NO: 444676 - DNA, 379 bp, Homo sapiens
  misc_feature: HEFZJCU01DC6E5.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcaaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 444677 - DNA, 477 bp, Homo sapiens; identical to SEQ ID NO: 444659
  misc_feature: HEFZJCU01CYINQ.16.10.A10.1.454.heavy.3.raw

SEQ ID NO: 444678 - DNA, 390 bp, Homo sapiens; identical to SEQ ID NO: 444541
  misc_feature: HEFZJCU01A7ON0.16.24.C02.1.454.heavy.3.raw

SEQ ID NO: 444679 - DNA, 312 bp, Homo sapiens
  misc_feature: HEFZJCU01A6JH0.11.59.F04.1.454.heavy.3.raw
cgagagataccacgaccggtgctcgatttagtacacacacttagggattggggctgggagaggagcccagcactagaagtcggcggtgtctccattcggtgatcagcactgaacacagaggactcaccatggagtttgggctgaactgggttttcctcgtagctcttttaagaagtgattcatggagaatagagagactgagtcctccaccaagggcccatcggtcttccccctggcaccctcctccaagagcacctctgggggcacagcggccctgggctgcctggtcaaggactacttccgtatctctcg

SEQ ID NO: 444680 - DNA, 393 bp, Homo sapiens
  misc_feature: HEFZJCU01BE7N8.3.12.B01.1.454.heavy.3.raw
agacgcactccacgaccggtgctcgatttagtagtgtagattccgcgggttgtagtcggtgctcccaccatagtgggagcaccgactacaacccgtccctcaagagtcgagtcaccatatcagtagacacgtccaagaatcagatctccctgaacgtgacctctgtgacggccgcagacacggccgtctattactgtgccagttcgtcacatatgcttacgtctgggggagatatcgttttctctgacaactgggccagggttccctggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 444681 - DNA, 422 bp, Homo sapiens
  misc_feature: HEFZJCU01B1RJC.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444682 - DNA, 392 bp, Homo sapiens
  misc_feature: HEFZJCU01DW3LY.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444683 - DNA, 379 bp, Homo sapiens; identical to SEQ ID NO: 444450
  misc_feature: HEFZJCU01CGYHY.47.77.G11.1.454.heavy.3.raw

SEQ ID NO: 444684 - DNA, 379 bp, Homo sapiens; identical to SEQ ID NO: 444450
  misc_feature: HEFZJCU01CDDWP.47.77.G11.1.454.heavy.3.raw

SEQ ID NO: 444685 - DNA, 339 bp, Homo sapiens; identical to SEQ ID NO: 444436
  misc_feature: HEFZJCU01DTL6B.47.38.D05.1.454.heavy.3.raw

SEQ ID NO: 444686 - DNA, 436 bp, Homo sapiens
  misc_feature: HEFZJCU01A2W0U.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 444687 - DNA, 402 bp, Homo sapiens
  misc_feature: HEFZJCU01CGYJK.13.61.F06.1.454.heavy.3.raw
tcacgtactacacgaccggtgctcgatttagctacgctctaagggaaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttccccctggcgccctgctccaggagcacctccgagagcacagcggccctgggctgcctggtcaaggactacttcctagtacgtga

SEQ ID NO: 444688 - DNA, 460 bp, Homo sapiens
  misc_feature: HEFZJCU01CERLO.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 444689 - DNA, 410 bp, Homo sapiens
  misc_feature: HEFZJCU01DN5OT.52.87.H10.1.454.heavy.3.raw
cgcagtacgacacgaccggtgctcgatttagcagtactgcgttgggtttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 444690 - DNA, 399 bp, Homo sapiens
  misc_feature: HEFZJCU01A7X1W.4.79.H02.1.454.heavy.3.raw
agcactgtagcacgaccggtgctcgatttagtgtcacacgaagggaaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttccccctggcgccctgctccaggagcacctccgagagcacagcggccctgggctgcctggtcaaggactacttccctacagtgct

SEQ ID NO: 444691 - DNA, 396 bp, Homo sapiens; identical to SEQ ID NO: 444469
  misc_feature: HEFZJCU01B8CPG.47.46.E02.1.454.heavy.3.raw

SEQ ID NO: 444692 - DNA, 386 bp, Homo sapiens
  misc_feature: HEFZJCU01ARRMG.11.27.C05.1.454.heavy.3.raw
cgagagataccacgaccggtgctcgatttagacgcgatcgaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatgctttgatttctggggccaagggacaatgctcaccgtctcttcagcctccaccaagggcccatcggtcttccccctggcaccctcctccaagagcacctctgggggcacagcggccctgggctgcctggtcaaggactacttccgtatctctcg

SEQ ID NO: 444693 - DNA, 464 bp, Homo sapiens
  misc_feature: HEFZJCU01CYX72.9.30.C08.1.454.heavy.3.raw
tgatacgtctcacgaccggtgctcgatttagtctgacgtcaaagggaaagggttgtagtaggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 444694 - DNA, 379 bp, Homo sapiens; identical to SEQ ID NO: 444450
  misc_feature: HEFZJCU01B4RD8.47.77.G11.1.454.heavy.3.raw

SEQ ID NO: 444695 - DNA, 492 bp, Homo sapiens
  misc_feature: HEFZJCU01EK9UB.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 444696 - DNA, 506 bp, Homo sapiens
  misc_feature: HEFZJCU01BOMSS.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 444697 - DNA, 496 bp, Homo sapiens
  misc_feature: HEFZJCU01DA6G2.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 444698 - DNA, 350 bp, Homo sapiens; identical to SEQ ID NO: 444420
  misc_feature: HEFZJCU01A2BAO.40.36.D03.1.454.heavy.3.raw

SEQ ID NO: 444699 - DNA, 379 bp, Homo sapiens; identical to SEQ ID NO: 444450
  misc_feature: HEFZJCU01ACXJ6.47.77.G11.1.454.heavy.3.raw

SEQ ID NO: 444700 - DNA, 494 bp, Homo sapiens
  misc_feature: HEFZJCU01CZRNQ.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggccatcggtcttcccctggcgccctgctccaggagcacctccgagagcacagcggccctgggctgcctggtcaaggactacttccctacagtgct

SEQ ID NO: 444701 - DNA, 394 bp, Homo sapiens
  misc_feature: HEFZJCU01C14G3.3.12.B01.1.454.heavy.3.raw
agacgcactccacgaccggtgctcgatttagtagtgtagattccgcgggttgtagtcggtgctcccaccatagtgggagcaccgactacaacccgtccctcaagagtcgagtcaccatatcagtagacacgtccaagaatcagatctccctgaacgtgacctctgtgacggccgcagacacggccgtctattactgtgccagttcgtcacatatgcttacgtctgggggagatatcgttttctctgacaactggggccagggttccctggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 444702 - DNA, 384 bp, Homo sapiens; identical to SEQ ID NO: 444454
  misc_feature: HEFZJCU01BW0RN.11.61.F06.1.454.heavy.3.raw

SEQ ID NO: 444703 - DNA, 379 bp, Homo sapiens; identical to SEQ ID NO: 444450
  misc_feature: HEFZJCU01EJJFN.47.77.G11.1.454.heavy.3.raw

SEQ ID NO: 444704 - DNA, 375 bp, Homo sapiens; identical to SEQ ID NO: 444442
  misc_feature: HEFZJCU01D1LYB.48.23.C01.1.454.heavy.3.raw

SEQ ID NO: 444705 - DNA, 412 bp, Homo sapiens
  misc_feature: HEFZJCU01ESSTO.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 444706 - DNA, 396 bp, Homo sapiens; identical to SEQ ID NO: 444469
  misc_feature: HEFZJCU01BV30N.47.46.E02.1.454.heavy.3.raw

SEQ ID NO: 444707 - DNA, 371 bp, Homo sapiens
  misc_feature: HEFZJCU01EM6QK.3.42.D09.1.454.heavy.3.raw
agacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctggggcacagcggccctgggctgcctggtcaaggactacttccgagtgcgtct

SEQ ID NO: 444708 - DNA, 427 bp, Homo sapiens
  misc_feature: HEFZJCU01C7XXA.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 444709 - DNA, 400 bp, Homo sapiens; identical to SEQ ID NO: 444452
  misc_feature: HEFZJCU01EYPR2.47.24.C02.1.454.heavy.3.raw

SEQ ID NO: 444710 - DNA, 524 bp, Homo sapiens
  misc_feature: HEFZJCU01BWIGI.12.40.D07.1.454.heavy.3.raw
atacgacgtacacgaccggtgctcgatttagtgatagagcgtaacaacagagggctcaccatggagtttgggctgagcggtcggtttcgtcgtaggcgtctttaagtaggtgtcagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 444711 - DNA, 500 bp, Homo sapiens
  misc_feature: HEFZJCU01BU4DZ.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaggggacaatggtcaccgtct

SEQ ID NO: 444712 - DNA, 506 bp, Homo sapiens; identical to SEQ ID NO: 444696
  misc_feature: HEFZJCU01A6B9X.16.34.D01.1.454.heavy.3.raw

SEQ ID NO: 444713 - DNA, 506 bp, Homo sapiens
  misc_feature: HEFZJCU01ARN6Y.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcagcctccaccaagggcccatcggtcttcccctggcaccctcct

SEQ ID NO: 444714 - DNA, 339 bp, Homo sapiens; identical to SEQ ID NO: 444436
  misc_feature: HEFZJCU01EN5S1.47.38.D05.1.454.heavy.3.raw

SEQ ID NO: 444715 - DNA, 352 bp, Homo sapiens; identical to SEQ ID NO: 444485
  misc_feature: HEFZJCU01ESSWY.10.38.D05.1.454.heavy.3.raw

SEQ ID NO: 444716 - DNA, 447 bp, Homo sapiens
  misc_feature: HEFZJCU01EL7YU.51.73.G07.1.454.heavy.3.raw
cgatcgtatacacgaccggtgctcgatttagctctacgctcagggcacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 444717 - DNA, 315 bp, Homo sapiens; identical to SEQ ID NO: 444422
  misc_feature: HEFZJCU01AZCSV.47.84.H07.1.454.heavy.3.raw

SEQ ID NO: 444718 - DNA, 518 bp, Homo sapiens
  misc_feature: HEFZJCU01D9XHQ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 444719 - DNA, 324 bp, Homo sapiens; identical to SEQ ID NO: 444475
  misc_feature: HEFZJCU01B462V.18.17.B06.1.454.heavy.3.raw

SEQ ID NO: 444720 - DNA, 385 bp, Homo sapiens; identical to SEQ ID NO: 444438
  misc_feature: HEFZJCU01ATQGA.18.60.F05.1.454.heavy.3.raw

SEQ ID NO: 444721 - DNA, 482 bp, Homo sapiens
  misc_feature: HEFZJCU01CV201.19.67.G01.1.454.heavy.3.raw
tactctcgtgcacgaccggtgctcgatttagagtatacatattgggcttggtccagcctgggcggtcgtctgagacgtgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 444722 - DNA, 384 bp, Homo sapiens; identical to SEQ ID NO: 444454
  misc_feature: HEFZJCU01BHQ64.11.61.F06.1.454.heavy.3.raw

SEQ ID NO: 444723 - DNA, 354 bp, Homo sapiens
  misc_feature: HEFZJCU01AEE7H.13.6.A06.1.454.heavy.3.raw
tcacgtactacacgaccggtgctcgatttagatctactgacaggggttccagggcagactcacgattaccgcggacagatccacgagcacagtgtacatggagctgagccgcctgacatctgaagacacggccgtgtattactgtgcgagagatcggggactataccggggcgatattcgcgacctggacttctacttctacatggacgtctggggcaaagggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 444724 - DNA, 483 bp, Homo sapiens
  misc_feature: HEFZJCU01B76NX.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactactttccactactatg

SEQ ID NO: 444725 - DNA, 379 bp, Homo sapiens; identical to SEQ ID NO: 444450
  misc_feature: HEFZJCU01CRTKG.47.77.G11.1.454.heavy.3.raw

SEQ ID NO: 444726 - DNA, 396 bp, Homo sapiens; identical to SEQ ID NO: 444469
  misc_feature: HEFZJCU01EZZTU.47.46.E02.1.454.heavy.3.raw

SEQ ID NO: 444727 - DNA, 372 bp, Homo sapiens
  misc_feature: HEFZJCU01DQ8XJ.3.42.D09.1.454.heavy.3.raw
agacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 444728 - DNA, 375 bp, Homo sapiens
  misc_feature: HEFZJCU01A4N42.49.59.F04.1.454.heavy.3.raw
agtcgagagacacgaccggtgctcgatttagtacacacacttagggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444729 - DNA, 408 bp, Homo sapiens
  misc_feature: HEFZJCU01B6VH5.40.22.B11.1.454.heavy.3.raw
tctagcgactcacgaccggtgctcgatttagacgacagctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctacaattggagatactactactactacggtatggacgtctggggccaagggaccacggtctccgtctcctcagcttccaccaagggcccatcggtcttccccctggcgccctgctccaggagcacctctgggggcacagcggccctgggctgcctggtcaaggactacttccagtcgctaga

SEQ ID NO: 444730 - DNA, 368 bp, Homo sapiens; identical to SEQ ID NO: 444437
  misc_feature: HEFZJCU01ESXKR.12.12.B01.1.454.heavy.3.raw

SEQ ID NO: 444731 - DNA, 396 bp, Homo sapiens
  misc_feature: HEFZJCU01DDXPN.18.61.F06.1.454.heavy.3.raw
tacgagtatgcacgaccggtgctcgatttagctacgctctaagggaaaggggctggagtggttgagttttatatcatatgatggaggttacaaatattatgcagagtccgtgaagggccgattcatcatctccagagacaactccaagaacacactgtttctgcaagtggacagtctgagacctgaggacacggctgtatattactgtacgagagatccggggggtcacgaccactggaactactttaccttctggggccagggaaccctggtcatcgtctcctcagcctccaccaagggcccatcggtcttccccctggcgccctgctccaggagcacctccgagagcacagcggccctgggctgcctggtcaaggactacttcccatactcgta

SEQ ID NO: 444732 - DNA, 506 bp, Homo sapiens
  misc_feature: HEFZJCU01D8VSM.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaagggcccatcggtcttcccctggcaccctcctccaagagcacctctgggggcacagcggccctgggctgcctggtcaaggactacttccgtactagacg

SEQ ID NO: 444733 - DNA, 400 bp, Homo sapiens; identical to SEQ ID NO: 444452
  misc_feature: HEFZJCU01A17RI.47.24.C02.1.454.heavy.3.raw

SEQ ID NO: 444734 - DNA, 422 bp, Homo sapiens
  misc_feature: HEFZJCU01C0MFJ.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444735 - DNA, 400 bp, Homo sapiens; identical to SEQ ID NO: 444452
  misc_feature: HEFZJCU01ENNAC.47.24.C02.1.454.heavy.3.raw

SEQ ID NO: 444736 - DNA, 480 bp, Homo sapiens
  misc_feature: HEFZJCU01DHWSK.22.36.D03.1.454.heavy.3.raw
acatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccacgcgtatgt

SEQ ID NO: 444737 - DNA, 400 bp, Homo sapiens; identical to SEQ ID NO: 444452
  misc_feature: HEFZJCU01EME0A.47.24.C02.1.454.heavy.3.raw

SEQ ID NO: 444738 - DNA, 393 bp, Homo sapiens
  misc_feature: HEFZJCU01CMBVK.18.61.F06.1.454.heavy.3.raw
tacgagtatgcacgaccggtgctcgatttagctacgctctaagggaaaggggctggagtggttgagttttatatcatatgatggaggttacaaatattatgcagagtccgtgaagggccgattcatcatctccagagacaactccaagaacacactgtttctgcaagtggacagtctgagacctgaggacacggctgtatattactgtacgagagatccggggggtcacgaccactggaactactttaccttctggggccagggaaccctggtcatcgtctcctcagcctccaccaagggcccatcggtcttccccctggcgccctgctccaggagcacctccgagagcacagcggccctgggctgcctggtcaaggactacttcccctcgta

SEQ ID NO: 444739 - DNA, 378 bp, Homo sapiens; identical to SEQ ID NO: 444419
  misc_feature: HEFZJCU01BFM9F.47.77.G11.1.454.heavy.3.raw

SEQ ID NO: 444740 - DNA, 488 bp, Homo sapiens
  misc_feature: HEFZJCU01DY8U3.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctgtcaaggactacttcccatactcgta

SEQ ID NO: 444741 - DNA, 409 bp, Homo sapiens; identical to SEQ ID NO: 444519
  misc_feature: HEFZJCU01C8MQ9.3.41.D08.1.454.heavy.3.raw

SEQ ID NO: 444742 - DNA, 324 bp, Homo sapiens; identical to SEQ ID NO: 444475
  misc_feature: HEFZJCU01ED65N.18.17.B06.1.454.heavy.3.raw

SEQ ID NO: 444743 - DNA, 350 bp, Homo sapiens; identical to SEQ ID NO: 444420
  misc_feature: HEFZJCU01CS39Z.40.36.D03.1.454.heavy.3.raw

SEQ ID NO: 444744 - DNA, 482 bp, Homo sapiens
  misc_feature: HEFZJCU01AYINS.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactactccgtatctctcg

SEQ ID NO: 444745 - DNA, 627 bp, Homo sapiens
  misc_feature: HEFZJCU01E0GZL.13.42.D09.1.454.heavy.3.raw
tcacgtactacacgaccggtgctcgatttagacacatacgcagggaaaggcatacgcagggaaaggggctggagtgggtggccaacataaacacagacggaagtgacccatactatgcggactctgtgaagggccgattcaccatctccagagacaacgccaagaactcactatatttgcaaatggaccgcctgagagacgaggacacgggccgtagtagttaacttacgttggtcgacggaaggaagtaggggtcccgaacggaaacggtttacggtaccgtacctaagtttgggggacccgggggtaaccccttggggggtcccaaaccggggtacccaaaccggttccaaccggtcccttcccctacccaaaggggccccctacctacccggtaacgggttccccccctaggtccgggtcccctttcccccgtcggtcccgacccggtaggcctacccctaccgggaaggacgaccctacccgaaggacgggccctacgggacgtcgggtccccttgggggtcctaagggcccttacggttccctaaagggtaaccgttacgttacccttaggtaacggtcggggaccttgggacgaacgggggccgtcggactaagggcgcat

SEQ ID NO: 444746 - DNA, 374 bp, Homo sapiens
  misc_feature: HEFZJCU01BFKBG.49.38.D05.1.454.heavy.3.raw
agtcgagagacacgaccggtgctcgatttagtatctgatagttgggtttggggtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444747 - DNA, 379 bp, Homo sapiens; identical to SEQ ID NO: 444450
  misc_feature: HEFZJCU01EUGXZ.47.77.G11.1.454.heavy.3.raw

SEQ ID NO: 444748 - DNA, 338 bp, Homo sapiens
  misc_feature: HEFZJCU01DRGYH.11.26.C04.1.454.heavy.3.raw
cgagagataccacgaccggtgctcgatttagtctagcgactttgggtttgggtgccgaagttgctggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 444749 - DNA, 491 bp, Homo sapiens
  misc_feature: HEFZJCU01DOK52.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 444750 - DNA, 383 bp, Homo sapiens; identical to SEQ ID NO: 444477
  misc_feature: HEFZJCU01EY7CO.47.60.F05.1.454.heavy.3.raw

SEQ ID NO: 444751 - DNA, 469 bp, Homo sapiens
  misc_feature: HEFZJCU01E02XR.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccctggacactgcggtggcagggtatgatgcatttgatatctggggccaagggacaatggtcaccgtctcttcagcctccaccaagggcccatcggtctcccctggcgccctgctccaggagcacctccgagagcacagcggccctgggctgcctggtcaaggactacttccctacagtgct

SEQ ID NO: 444752 - DNA, 396 bp, Homo sapiens; identical to SEQ ID NO: 444469
  misc_feature: HEFZJCU01C7WHZ.47.46.E02.1.454.heavy.3.raw

SEQ ID NO: 444753 - DNA, 379 bp, Homo sapiens; identical to SEQ ID NO: 444450
  misc_feature: HEFZJCU01EFTXZ.47.77.G11.1.454.heavy.3.raw

SEQ ID NO: 444754 - DNA, 422 bp, Homo sapiens
  misc_feature: HEFZJCU01CRZJI.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcggggattacctcgacccctggggccagggaatactggtcaccgtctcctcagcctccaccaatggcccatcggtcttccccctggcaccctcctccaagagcacctctgggggcacagcggccctgggctgcctggtcaaggactacttccgagtagtaca

SEQ ID NO: 444755 - DNA, 314 bp, Homo sapiens
  misc_feature: HEFZJCU01CSHBM.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcgggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagct

SEQ ID NO: 444756 - DNA, 403 bp, Homo sapiens
  misc_feature: HEFZJCU01BEPE5.13.42.D09.1.454.heavy.3.raw
tcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctgggcccgggaaccctggtcaccgtctcctcagcctccaccaagggcccatcggtcttccccctggcaccctcctccaagagcacctctggggcacagcggccctgggctgcctggtcaaggactacttcctagtacgtga

SEQ ID NO: 444757 - DNA, 392 bp, Homo sapiens; identical to SEQ ID NO: 444456
  misc_feature: HEFZJCU01EY0ZP.7.60.F05.1.454.heavy.3.raw

SEQ ID NO: 444758 - DNA, 413 bp, Homo sapiens
  misc_feature: HEFZJCU01CGI9X.3.71.G05.1.454.heavy.3.raw
agacgcactccacgaccggtgctcgatttagtgtcgtcgcaagagagaggggagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgatttttggaactcttattaccgctttgactactggggccagggaaccctggtcaccgcctcctcagcctccaccaagggcccatcggtcttccccctggcaccctcctccaagagcacctctgggggcacagcggccctgggctgcctggtcaaggactacttccgagtgcgtct

SEQ ID NO: 444759 - DNA, 505 bp, Homo sapiens
  misc_feature: HEFZJCU01C6UN7.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttcccactacta

SEQ ID NO: 444760 - DNA, 379 bp, Homo sapiens; identical to SEQ ID NO: 444450
  misc_feature: HEFZJCU01CNXM2.47.77.G11.1.454.heavy.3.raw

SEQ ID NO: 444761 - DNA, 340 bp, Homo sapiens
  misc_feature: HEFZJCU01E1O5G.19.25.C03.1.454.heavy.3.raw
tactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagta

SEQ ID NO: 444762 - DNA, 315 bp, Homo sapiens; identical to SEQ ID NO: 444422
  misc_feature: HEFZJCU01EDIXH.47.84.H07.1.454.heavy.3.raw

SEQ ID NO: 444763 - DNA, 315 bp, Homo sapiens
  misc_feature: HEFZJCU01CYTVD.47.56.F01.1.454.heavy.3.raw
agctcacgtacacgaccggtgctcgatttagcagacgtctgtcgcagggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagct

SEQ ID NO: 444764 - DNA, 391 bp, Homo sapiens; identical to SEQ ID NO: 444514
  misc_feature: HEFZJCU01ETOMF.12.24.C02.1.454.heavy.3.raw

SEQ ID NO: 444765 - DNA, 400 bp, Homo sapiens; identical to SEQ ID NO: 444452
  misc_feature: HEFZJCU01AXUGB.47.24.C02.1.454.heavy.3.raw

SEQ ID NO: 444766 - DNA, 371 bp, Homo sapiens; identical to SEQ ID NO: 444707
  misc_feature: HEFZJCU01CTFBU.3.42.D09.1.454.heavy.3.raw

SEQ ID NO: 444767 - DNA, 373 bp, Homo sapiens
  misc_feature: HEFZJCU01AN84L.49.24.C02.1.454.heavy.3.raw
agtcgagagacacgaccggtgctcgatttagtacagatcgttagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 444768 - DNA, 502 bp, Homo sapiens
  misc_feature: HEFZJCU01CAG2V.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggagcacctccgagagcacagcggccctgggctgcctggtcaaggactacttcccgagcgacga

SEQ ID NO: 444769 - DNA, 379 bp, Homo sapiens; identical to SEQ ID NO: 444450
  misc_feature: HEFZJCU01BD8NL.47.77.G11.1.454.heavy.3.raw

SEQ ID NO: 444770 - DNA, 462 bp, Homo sapiens
  misc_feature: HEFZJCU01B8W5S.40.23.C01.1.454.heavy.3.raw
tctagcgactcacgaccggtgctcgatttagtacacgtgattagggattgggggattcacttttggtgattatgccatgcactgggtccggcaagctccagggaagggcctggagtgggtctcaggtattagttggaatagtggaagtattgactatggggactctgtgaagggccgattcaccatctccagagacaacgccaagaactccctgtatctgcaaatgagcagtctgagagctgaggacacggccttgtattactgtgcaaaagatactaggggaatagtagtgtctcggcggcttggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccagtcgctaga

SEQ ID NO: 444771 - DNA, 313 bp, Homo sapiens; identical to SEQ ID NO: 444428
  misc_feature: HEFZJCU01CJOO1.11.59.F04.1.454.heavy.3.raw

SEQ ID NO: 444772 - DNA, 423 bp, Homo sapiens
  misc_feature: HEFZJCU01DCNRC.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444773 - DNA, 379 bp, Homo sapiens
  misc_feature: HEFZJCU01D6H8I.3.59.F04.1.454.heavy.3.raw
agacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccagggaacccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 444774 - DNA, 314 bp, Homo sapiens
  misc_feature: HEFZJCU01CLDRI.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacg

SEQ ID NO: 444775 - DNA, 504 bp, Homo sapiens
  misc_feature: HEFZJCU01DICNJ.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggcctgggctgcctggtcaaggactactcctatgtatact

SEQ ID NO: 444776 - DNA, 396 bp, Homo sapiens; identical to SEQ ID NO: 444426
  misc_feature: HEFZJCU01DQR08.18.31.C09.1.454.heavy.3.raw

SEQ ID NO: 444777 - DNA, 400 bp, Homo sapiens
  misc_feature: HEFZJCU01CW66M.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctctaccaagggcccatcggtcttccccctggcgccctgctccaggagcacctccgagagcacagcggccctgggctgcctggtcaaggactacttcctacgtgagct

SEQ ID NO: 444778 - DNA, 384 bp, Homo sapiens
  misc_feature: HEFZJCU01BSGR7.21.46.E02.1.454.heavy.3.raw
tcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacga

SEQ ID NO: 444779 - DNA, 482 bp, Homo sapiens; identical to SEQ ID NO: 444503
  misc_feature: HEFZJCU01DNNWY.7.10.A10.1.454.heavy.3.raw

SEQ ID NO: 444780 - DNA, 396 bp, Homo sapiens
  misc_feature: HEFZJCU01BKLH8.47.59.F04.1.454.heavy.3.raw
agctcacgtacacgaccggtgctcgatttagtacacacacttagcgaggggcgtggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 444781 - DNA, 319 bp, Homo sapiens
  misc_feature: HEFZJCU01B1UST.53.8.A08.1.454.heavy.3.raw
cgcgtatacacacgaccggtgctcgatttagcatactctacagggacaattccaagaacaccctgtatctgcaattgagcagactcacagctgaggacacggctgtgtattactgtgtgaaagacgtttatgagagtagtggtttttccgagtacgcacattacggtatggacgtctggggccaagggaccccggtcaccgtctccttagcctccaccaagggcccatcggtcttccccctggcaccctcctccaagagcacctctgggggcacagcggccctgggctgcctggtcaaggactacttcctcgtactgcg

SEQ ID NO: 444782 - DNA, 424 bp, Homo sapiens
  misc_feature: HEFZJCU01DWE73.49.68.G02.1.454.heavy.3.raw
agtcgagagacacgaccggtgctcgatttagtcgatagtgaagggaaagggagggaaagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcatcgtctcctcagcctccaccaagggcccatcggtcttccccctggcaccctcctccaagagcacctctgggggcacagcggccctgggctgcctggtcaaggactacttcctctctcgact

SEQ ID NO: 444783 - DNA, 379 bp, Homo sapiens; identical to SEQ ID NO: 444450
  misc_feature: HEFZJCU01CITCM.47.77.G11.1.454.heavy.3.raw

SEQ ID NO: 444784 - DNA, 324 bp, Homo sapiens; identical to SEQ ID NO: 444475
  misc_feature: HEFZJCU01ERMGG.18.17.B06.1.454.heavy.3.raw

SEQ ID NO: 444785 - DNA, 499 bp, Homo sapiens
  misc_feature: HEFZJCU01CG4W8.12.38.D05.1.454.heavy.3.raw
atacgacgtacacgaccggtgctcgatttagtatctgatagttgggtctggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 444786 - DNA, 316 bp, Homo sapiens; identical to SEQ ID NO: 444444
  misc_feature: HEFZJCU01AF09Z.47.56.F01.1.454.heavy.3.raw

SEQ ID NO: 444787 - DNA, 520 bp, Homo sapiens
  misc_feature: HEFZJCU01DCX6F.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttcccctggcgccctgctccaggagcacctccgagagcacagcggccctgggctgcctggtcaaggactacttcctacg

SEQ ID NO: 444788 - DNA, 393 bp, Homo sapiens
  misc_feature: HEFZJCU01AY276.49.42.D09.1.454.heavy.3.raw
agtcgagagacacgaccggtgctcgatttagacacatacgcagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagtggccctgggctgcctggtcaaggactacttcctctctcgact

SEQ ID NO: 444789 - DNA, 509 bp, Homo sapiens
  misc_feature: HEFZJCU01C11EE.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctattttaaaaggtgtcagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactgggcgattatacatattatacagactccgtgaagggccgcttcaccatctccagagacaattccaagaaccacggtgtatctgcaaatgaacagcctgagagccgaaggcacggccacatattactgtgcgaagatctcgggctggttccgcggtccgggg

SEQ ID NO: 444790 - DNA, 352 bp, Homo sapiens
  misc_feature: HEFZJCU01ERFJ0.49.39.D06.1.454.heavy.3.raw
agtcgagagacacgaccggtgctcgatttagtgacatctcgcagttctttgggtagtaatcgttgcctgccgcacagtaatacacagccgagtcaccatctccagacacaattccaagaacacggtgtttctgctggtgaacagcctgagaactgaggacacggctgtgtattactgtgcggcaggcaacgattactacccgaaggactactggggccagggaaccctggtcaccgtctcctcagcctccaccaagggcccatcggtcttcccctggcaccctcctccaagagcacctctggggcacagcggccctgggctgcctggtcaaggactacttcctctctcgact

SEQ ID NO: 444791 - DNA, 489 bp, Homo sapiens
  misc_feature: HEFZJCU01BNJX3.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 444792 - DNA, 496 bp, Homo sapiens
  misc_feature: HEFZJCU01EDDE4.40.34.D01.1.454.heavy.3.raw
tctagcgactcacgaccggtgctcgatttagatcgtctgtgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccgggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 444793 - DNA, 466 bp, Homo sapiens
  misc_feature: HEFZJCU01D96ND.48.9.A09.1.454.heavy.3.raw
agtatacatacacgaccggtgctcgatttagcgagacgcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcggcctgggctgcctggtcaaggactacttcctatgtatact

SEQ ID NO: 444794 - DNA, 415 bp, Homo sapiens
  misc_feature: HEFZJCU01ENAET.14.74.G08.1.454.heavy.3.raw
cgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 444795 - DNA, 576 bp, Homo sapiens
  misc_feature: HEFZJCU01ECUBF.18.33.C11.1.454.heavy.3.raw
  modified_base (471)..(471): a, c, t, g, unknown or other
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctcccacctccaccaagggcccatcggtcttccccctggcgccctcgcctacgaggacgaccncctcgggacgaacgacgaccgaccgtcgggcccgtgggcctggtcccgtaagggtacctaaacggttaccctaactttaccctacgttaaccttcggtaacgtcc

SEQ ID NO: 444796 - DNA, 372 bp, Homo sapiens; identical to SEQ ID NO: 444727
  misc_feature: HEFZJCU01DRV6B.3.42.D09.1.454.heavy.3.raw

SEQ ID NO: 444797 - DNA, 493 bp, Homo sapiens
  misc_feature: HEFZJCU01D4K7E.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctgggctgcctggtcaaggactacttccctaccagtgct

SEQ ID NO: 444798 - DNA, 398 bp, Homo sapiens
  misc_feature: HEFZJCU01EDQQA.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 444799 - DNA, 489 bp, Homo sapiens; identical to SEQ ID NO: 444791
  misc_feature: HEFZJCU01ETXZ6.47.85.H08.1.454.heavy.3.raw

SEQ ID NO: 444800 - DNA, 499 bp, Homo sapiens
  misc_feature: HEFZJCU01CWXOZ.10.71.G05.1.454.heavy.3.raw
catagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagcgtggtttcgtcgttagctctttaagagatgtccagtgtcagatgcagatggtggagtctgggggaggcgtggtccggcctgggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgaagagccgaggacacggggtgtttattactgtgggagaaatcctagtggcatcaccg

SEQ ID NO: 444801 - DNA, 510 bp, Homo sapiens
  misc_feature: HEFZJCU01ER3YQ.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctcccactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggcgccctgctccaggagcacctccgagagcacagcggccctgggcc

SEQ ID NO: 444802 - DNA, 379 bp, Homo sapiens; identical to SEQ ID NO: 444450
  misc_feature: HEFZJCU01E2QW3.47.77.G11.1.454.heavy.3.raw

SEQ ID NO: 444803 - DNA, 491 bp, Homo sapiens
  misc_feature: HEFZJCU01B56FL.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggccctgggctgcctggtcaaggactacttccctacagtgct

SEQ ID NO: 444804 - DNA, 470 bp, Homo sapiens
  misc_feature: HEFZJCU01D2JMO.48.1.A01.1.454.heavy.3.raw
agtatacatacacgaccggtgctcgatttagacgtctcatcaaggaaggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgtggcacggactactggggccagggaaccctagtcaccgtctcctcagcctccaccaagggcccatcggtcttcccctgcgccctgctccaggagcacctccgagagcacagcggccctgggctgcctggtcaaggactacttcctatgtatact

SEQ ID NO: 444805 - DNA, 465 bp, Homo sapiens
  misc_feature: HEFZJCU01EXI45.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 444806 - DNA, 393 bp, Homo sapiens
  misc_feature: HEFZJCU01BWCTU.49.45.E01.1.454.heavy.3.raw
agtcgagagacacgaccggtgctcgatttagtgagtcagtaagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444807 - DNA, 368 bp, Homo sapiens; identical to SEQ ID NO: 444437
  misc_feature: HEFZJCU01BEX8V.12.12.B01.1.454.heavy.3.raw

SEQ ID NO: 444808 - DNA, 400 bp, Homo sapiens; identical to SEQ ID NO: 444452
  misc_feature: HEFZJCU01EZR7T.47.24.C02.1.454.heavy.3.raw

SEQ ID NO: 444809 - DNA, 379 bp, Homo sapiens; identical to SEQ ID NO: 444450
  misc_feature: HEFZJCU01DX2ZF.47.77.G11.1.454.heavy.3.raw

SEQ ID NO: 444810 - DNA, 505 bp, Homo sapiens
  misc_feature: HEFZJCU01BOYCM.14.37.D04.1.454.heavy.3.raw
cgtctagtaccacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggactacttccgtactaacg

SEQ ID NO: 444811 - DNA, 324 bp, Homo sapiens; identical to SEQ ID NO: 444475
  misc_feature: HEFZJCU01CUZUU.18.17.B06.1.454.heavy.3.raw

SEQ ID NO: 444812 - DNA, 321 bp, Homo sapiens
  misc_feature: HEFZJCU01CFU23.52.20.B09.1.454.heavy.3.raw
cgcagtacgacacgaccggtgctcgatttagtgtagtgtgaagggccgattcaccatttccagagacagctccgataacacggtctatctgcgaatgaacagcctgagacctgaggacacggctcttttttactgtgcgccaggaagcagtggctggccacatgatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctatacgatcg

SEQ ID NO: 444813 - DNA, 427 bp, Homo sapiens; identical to SEQ ID NO: 444708
  misc_feature: HEFZJCU01EZ43C.9.34.D01.1.454.heavy.3.raw

SEQ ID NO: 444814 - DNA, 392 bp, Homo sapiens; identical to SEQ ID NO: 444456
  misc_feature: HEFZJCU01DGDKZ.7.60.F05.1.454.heavy.3.raw

SEQ ID NO: 444815 - DNA, 402 bp, Homo sapiens
  misc_feature: HEFZJCU01DWHKL.11.70.G04.1.454.heavy.3.raw
cgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 444816 - DNA, 396 bp, Homo sapiens
  misc_feature: HEFZJCU01CF80W.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataacttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 444817 - DNA, 392 bp, Homo sapiens; identical to SEQ ID NO: 444456
  misc_feature: HEFZJCU01BYJ0N.7.60.F05.1.454.heavy.3.raw

SEQ ID NO: 444818 - DNA, 387 bp, Homo sapiens
  misc_feature: HEFZJCU01CVQAE.11.79.H02.1.454.heavy.3.raw
cgagagataccacgaccggtgctcgatttagtgtcacacgaagggaaaggggctggagtgggtctcgtctattgctggcaatgataataccgtaaactacgcagactccgtgaagggccggttcaccatctccagggacaattccatgaacacactttatcttcaattgaacaccctgagggccgacgacacggccgtatattactgtgcgaaggactacgatctcgagtacttctttgaccactggggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 444819 - DNA, 379 bp, Homo sapiens; identical to SEQ ID NO: 444450
  misc_feature: HEFZJCU01EVWKT.47.77.G11.1.454.heavy.3.raw

SEQ ID NO: 444820 - DNA, 315 bp, Homo sapiens
  misc_feature: HEFZJCU01EI1SQ.13.66.F11.1.454.heavy.3.raw
tcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttcccctggcgccctgctccaggagcacctctggggcacagcggccctgggctgcctggtcaaggactacttccgtactagacg

SEQ ID NO: 444821 - DNA, 396 bp, Homo sapiens; identical to SEQ ID NO: 444426
  misc_feature: HEFZJCU01CXYLO.18.31.C09.1.454.heavy.3.raw

SEQ ID NO: 444822 - DNA, 477 bp, Homo sapiens
  misc_feature: HEFZJCU01BYTAQ.40.34.D01.1.454.heavy.3.raw
tctagcgactcacgaccggtgctcgatttagatcgtctgtgttgggtttggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 444823 - DNA, 313 bp, Homo sapiens; identical to SEQ ID NO: 444428
  misc_feature: HEFZJCU01EQ6IB.11.59.F04.1.454.heavy.3.raw

SEQ ID NO: 444824 - DNA, 336 bp, Homo sapiens; identical to SEQ ID NO: 444429
  misc_feature: HEFZJCU01ASNOZ.14.28.C06.1.454.heavy.3.raw

SEQ ID NO: 444825 - DNA, 494 bp, Homo sapiens
  misc_feature: HEFZJCU01ADAGT.22.11.A11.1.454.heavy.3.raw
acatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaatttccaagccgcgggggtc

SEQ ID NO: 444826 - DNA, 399 bp, Homo sapiens
  misc_feature: HEFZJCU01BKU9R.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacgctgtatctgcaaatgaacagcctgagagtcgaggacacggccgtatattattgtgcgaaagacgtatgtagtggtgactgcttgttggagtcttttgactacgtgggccagggaaccctggtcatcgtctcctcagcctccaccaagggcccatcggtcttccccctgacaccctcctccaagagcacctctgggggcacagcggccctgggctgcctggtcaaggactacttccgagtagtaca

SEQ ID NO: 444827 - DNA, 492 bp, Homo sapiens
  misc_feature: HEFZJCU01AFW5E.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctgggctgcctggtcaaggactacttccctacagtgct

SEQ ID NO: 444828 - DNA, 395 bp, Homo sapiens
  misc_feature: HEFZJCU01CROIN.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 444829 - DNA, 409 bp, Homo sapiens; identical to SEQ ID NO: 444519
  misc_feature: HEFZJCU01EM6XS.3.41.D08.1.454.heavy.3.raw

SEQ ID NO: 444830 - DNA, 385 bp, Homo sapiens; identical to SEQ ID NO: 444438
  misc_feature: HEFZJCU01AKHE8.18.60.F05.1.454.heavy.3.raw

SEQ ID NO: 444831 - DNA, 396 bp, Homo sapiens; identical to SEQ ID NO: 444469
  misc_feature: HEFZJCU01CN9UT.47.46.E02.1.454.heavy.3.raw

SEQ ID NO: 444832 - DNA, 468 bp, Homo sapiens
  misc_feature: HEFZJCU01B0UF2.49.10.A10.1.454.heavy.3.raw
agtcgagagacacgaccggtgctcgatttagcgtcgatctcaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggcccccctttcaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444833 - DNA, 378 bp, Homo sapiens; identical to SEQ ID NO: 444419
  misc_feature: HEFZJCU01BR215.47.77.G11.1.454.heavy.3.raw

SEQ ID NO: 444834 - DNA, 317 bp, Homo sapiens
  misc_feature: HEFZJCU01C4R8N.13.66.F11.1.454.heavy.3.raw
tcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtcgtcctcagcttccaccaagggcccatcggtcttccccctggcgccctgctccaggagcacctctggggcacagcggccctgggctgcctggtcaaggactacttcctagtacgtga

SEQ ID NO: 444835 - DNA, 336 bp, Homo sapiens; identical to SEQ ID NO: 444510
  misc_feature: HEFZJCU01APLL3.3.31.C09.1.454.heavy.3.raw

SEQ ID NO: 444836 - DNA, 481 bp, Homo sapiens
  misc_feature: HEFZJCU01D0CQC.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggctacttcctacgtgagct

SEQ ID NO: 444837 - DNA, 394 bp, Homo sapiens
  misc_feature: HEFZJCU01CKGRM.14.25.C03.1.454.heavy.3.raw
cgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 444838 - DNA, 396 bp, Homo sapiens; identical to SEQ ID NO: 444426
  misc_feature: HEFZJCU01ECFMJ.18.31.C09.1.454.heavy.3.raw

SEQ ID NO: 444839 - DNA, 379 bp, Homo sapiens; identical to SEQ ID NO: 444773
  misc_feature: HEFZJCU01CDSPV.3.59.F04.1.454.heavy.3.raw

SEQ ID NO: 444840 - DNA, 379 bp, Homo sapiens; identical to SEQ ID NO: 444450
  misc_feature: HEFZJCU01CCX0Q.47.77.G11.1.454.heavy.3.raw

SEQ ID NO: 444841 - DNA, 390 bp, Homo sapiens; identical to SEQ ID NO: 444541
  misc_feature: HEFZJCU01AS5UN.16.24.C02.1.454.heavy.3.raw

SEQ ID NO: 444842 - DNA, 317 bp, Homo sapiens
  misc_feature: HEFZJCU01C5J57.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctcggcaccctcctccaagagcacctctggggcgacagcggccctgggctgcctggtcaaggactacttcctacgtgagct

SEQ ID NO: 444843 - DNA, 381 bp, Homo sapiens; identical to SEQ ID NO: 444648
  misc_feature: HEFZJCU01EQMEG.9.53.E09.1.454.heavy.3.raw

SEQ ID NO: 444844 - DNA, 502 bp, Homo sapiens
  misc_feature: HEFZJCU01C5TDR.15.55.E11.1.454.heavy.3.raw
tctacgtagccacgaccggtgctcgatttagcactcgcacgttgggtttggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 444845 - DNA, 378 bp, Homo sapiens; identical to SEQ ID NO: 444419
  misc_feature: HEFZJCU01BVSMP.47.77.G11.1.454.heavy.3.raw

SEQ ID NO: 444846 - DNA, 402 bp, Homo sapiens
  misc_feature: HEFZJCU01ASZ6R.14.60.F05.1.454.heavy.3.raw
cgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcggggttcgacccctggggccagggaaccctggtcaccgtctcctcagcttccaccaagggcccatcggtcttccccctggcgccctgctccaggagcacctctgggggcacagcggccctgggctgcctggtcaaggactacttccgtactagacg

SEQ ID NO: 444847 - DNA, 380 bp, Homo sapiens
  misc_feature: HEFZJCU01D23DO.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactaccttcctacgtgagct

SEQ ID NO: 444848 - DNA, 516 bp, Homo sapiens
  misc_feature: HEFZJCU01BO7EB.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcggcctgggctgcctggtcaaggactacttccagacgtatca

SEQ ID NO: 444849 - DNA, 436 bp, Homo sapiens
  misc_feature: HEFZJCU01BHQ21.53.40.D07.1.454.heavy.3.raw
cgcgtatacacacgaccggtgctcgatttagtgatagagcgtaacaacagagggtctgctgggcctcccatggggtgtcctgtcacaggtacagctgcagcagtcaggtccaggactggtgaagccctcgcagaccctctcactcacctgtggcatctccggggacagtgtctctagcaacagcgctgcttggaattggatcaggcagtccccttcgagaggccttgagtggctgggaaggacatactacaggtccaagtggtataatgattatgctgtatctgtaaaagtcgaataagcatcaacccagacacatccaagaaccagttctcccttcagctgaactctgtgactcccgaggacacggctgtctattactgtgcaagtgagtcccgctatagcagtgcctggtcaaggactacttcctcgtactgcg

SEQ ID NO: 444850 - DNA, 379 bp, Homo sapiens; identical to SEQ ID NO: 444450
  misc_feature: HEFZJCU01APE50.47.77.G11.1.454.heavy.3.raw

SEQ ID NO: 444851 - DNA, 316 bp, Homo sapiens; identical to SEQ ID NO: 444479
  misc_feature: HEFZJCU01CM7DA.47.84.H07.1.454.heavy.3.raw

SEQ ID NO: 444852 - DNA, 469 bp, Homo sapiens
  misc_feature: HEFZJCU01DSM1E.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcgccctgggctgcctggtcaaggactacttccctacagtgct

SEQ ID NO: 444853 - DNA, 374 bp, Homo sapiens; identical to SEQ ID NO: 444640
  misc_feature: HEFZJCU01CVG42.7.37.D04.1.454.heavy.3.raw

SEQ ID NO: 444854 - DNA, 313 bp, Homo sapiens
  misc_feature: HEFZJCU01B6EIE.49.11.A11.1.454.heavy.3.raw
agtcgagagacacgaccggtgctcgatttagctacgactgcagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 444855 - DNA, 375 bp, Homo sapiens; identical to SEQ ID NO: 444442
  misc_feature: HEFZJCU01DV59U.48.23.C01.1.454.heavy.3.raw

SEQ ID NO: 444856 - DNA, 315 bp, Homo sapiens; identical to SEQ ID NO: 444422
  misc_feature: HEFZJCU01C0O79.47.84.H07.1.454.heavy.3.raw

SEQ ID NO: 444857 - DNA, 372 bp, Homo sapiens
  misc_feature: HEFZJCU01BJ8PD.13.76.G10.1.454.heavy.3.raw
  modified_base (150)..(150): a, c, t, g, unknown or other
tcacgtactacacgaccggtgctcgatttagtcactcatacagggggggagagggagcccagcactgggattccgaggtgtttccattcggtggatcagcactgaacacagaggactaaccatggagttttggctgagcgtggtttcgtntagctatttaaaggtgccagtgtgaggtgcagctggtggagtcgtggaggaggcttggatcccagcctggggggtccctggagactctcctgtgccaggcctctgggttcaccgtcagtcacacctcatgagctgggtccgccaggctccgagggaaggggctggagtgcgtctcttttattatagtagtggtagtcatactccgcagactccgtgagggcc

SEQ ID NO: 444858 - DNA, 327 bp, Homo sapiens; identical to SEQ ID NO: 444439
  misc_feature: HEFZJCU01EPI25.40.20.B09.1.454.heavy.3.raw

SEQ ID NO: 444859 - DNA, 316 bp, Homo sapiens; identical to SEQ ID NO: 444479
  misc_feature: HEFZJCU01D8JS2.47.84.H07.1.454.heavy.3.raw

SEQ ID NO: 444860 - DNA, 325 bp, Homo sapiens
  misc_feature: HEFZJCU01A41RO.40.20.B09.1.454.heavy.3.raw
tctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttcccctggcgccctgctccaggagcacctctgggggcacagcggcctgggctgcctggtcaaggactacttccagtcgctaga

SEQ ID NO: 444861 - DNA, 486 bp, Homo sapiens
  misc_feature: HEFZJCU01D65G6.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgccctgctccaggagcacctccgagagcacagcggccctgggctgcctggtcaaggactacttcctacgtgagct

SEQ ID NO: 444862 - DNA, 400 bp, Homo sapiens; identical to SEQ ID NO: 444452
  misc_feature: HEFZJCU01A1EYF.47.24.C02.1.454.heavy.3.raw

SEQ ID NO: 444863 - DNA, 399 bp, Homo sapiens
  misc_feature: HEFZJCU01B8NG8.4.77.G11.1.454.heavy.3.raw
agcactgtagcacgaccggtgctcgatttagctagtcactcaagggaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctccgagagcacagcggccctgggctgcctggtcaaggactacttccctacagtgct

SEQ ID NO: 444864 - DNA, 500 bp, Homo sapiens
  misc_feature: HEFZJCU01EKF5T.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 444865 - DNA, 397 bp, Homo sapiens
  misc_feature: HEFZJCU01BJX8X.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtcgtatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 444866 - DNA, 470 bp, Homo sapiens
  misc_feature: HEFZJCU01EQYRX.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactacttccctacagtgct

SEQ ID NO: 444867 - DNA, 519 bp, Homo sapiens
  misc_feature: HEFZJCU01E1YC1.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 444868 - DNA, 518 bp, Homo sapiens; identical to SEQ ID NO: 444718
  misc_feature: HEFZJCU01D1H0V.9.34.D01.1.454.heavy.3.raw

SEQ ID NO: 444869 - DNA, 506 bp, Homo sapiens; identical to SEQ ID NO: 444732
  misc_feature: HEFZJCU01EZDLD.14.78.H01.1.454.heavy.3.raw

SEQ ID NO: 444870 - DNA, 374 bp, Homo sapiens
  misc_feature: HEFZJCU01BZ4OB.11.26.C04.1.454.heavy.3.raw
cgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacccgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 444871 - DNA, 347 bp, Homo sapiens
  misc_feature: HEFZJCU01B7UJI.51.38.D05.1.454.heavy.3.raw
cgatcgtatacacgaccggtgctcgatttagtatctgatagttgggtttgggtgcccaagctgctggagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 444872 - DNA, 538 bp, Homo sapiens
  misc_feature: HEFZJCU01D088Q.14.57.F02.1.454.heavy.3.raw
cgtctagtaccacgaccggtgctcgatttagctcgatatagttgggtttgggctgagtgggctcgttctaggtggctattttaaagatgtccagtgtgaggtgcagctgttggagtccgggggaggcttggtacagccgggggggtccctgacactctcctgtgcagcctcaggattcattttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctgggggcacagcc

SEQ ID NO: 444873 - DNA, 489 bp, Homo sapiens; identical to SEQ ID NO: 444591
  misc_feature: HEFZJCU01D3LFI.18.70.G04.1.454.heavy.3.raw

SEQ ID NO: 444874 - DNA, 400 bp, Homo sapiens
  misc_feature: HEFZJCU01B2WPR.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggatgcctggtcaaggactacttcctacgtgagct

SEQ ID NO: 444875 - DNA, 400 bp, Homo sapiens; identical to SEQ ID NO: 444452
  misc_feature: HEFZJCU01ATFLW.47.24.C02.1.454.heavy.3.raw

SEQ ID NO: 444876 - DNA, 482 bp, Homo sapiens; identical to SEQ ID NO: 444503
  misc_feature: HEFZJCU01EU9GH.7.10.A10.1.454.heavy.3.raw

SEQ ID NO: 444877 - DNA, 409 bp, Homo sapiens
  misc_feature: HEFZJCU01B0AKK.49.41.D08.1.454.heavy.3.raw
agtcgagagacacgaccggtgctcgatttagtcacgcgagaaagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 444878 - DNA, 487 bp, Homo sapiens
  misc_feature: HEFZJCU01EFAZ2.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggcgccctgctccaggagcacctccgagagcacagcggcctgggctgcctggtcaaggactacttcctacgtgagct

SEQ ID NO: 444879 - DNA, 482 bp, Homo sapiens
  misc_feature: HEFZJCU01C26JB.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 444880 - DNA, 390 bp, Homo sapiens; identical to SEQ ID NO: 444541
  misc_feature: HEFZJCU01BF64X.16.24.C02.1.454.heavy.3.raw

SEQ ID NO: 444881 - DNA, 398 bp, Homo sapiens; identical to SEQ ID NO: 444524
  misc_feature: HEFZJCU01ETH4T.7.60.F05.1.454.heavy.3.raw

SEQ ID NO: 444882 - DNA, 385 bp, Homo sapiens
  misc_feature: HEFZJCU01ATY02.49.53.E09.1.454.heavy.3.raw
agtcgagagacacgaccggtgctcgatttagagagagtgtgttgggtttggggtgggtctctcttattaattgggatggtggtatcacctactatgcagactctgtgaagggtcgattcaccatctccagagacaacagcagaaactccctgtatctgcaaatgaacagtctcagaggtgtaggacaccgccttctactactgtgcaaaagattacggtgaccacacctattttgaccgactgcggccagggaaccctaggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444883 - DNA, 371 bp, Homo sapiens; identical to SEQ ID NO: 444707
  misc_feature: HEFZJCU01ANLFD.3.42.D09.1.454.heavy.3.raw

SEQ ID NO: 444884 - DNA, 396 bp, Homo sapiens; identical to SEQ ID NO: 444426
  misc_feature: HEFZJCU01EIA1Y.18.31.C09.1.454.heavy.3.raw

SEQ ID NO: 444885 - DNA, 499 bp, Homo sapiens; identical to SEQ ID NO: 444610
  misc_feature: HEFZJCU01DRNKI.15.70.G04.1.454.heavy.3.raw

SEQ ID NO: 444886 - DNA, 400 bp, Homo sapiens; identical to SEQ ID NO: 444452
  misc_feature: HEFZJCU01DEMNS.47.24.C02.1.454.heavy.3.raw

SEQ ID NO: 444887 - DNA, 403 bp, Homo sapiens
  misc_feature: HEFZJCU01B7G83.51.30.C08.1.454.heavy.3.raw
cgatcgtatacacgaccggtgctcgatttagtctgacgtcaaagggaaaggggctggagtgggtggcacttatctcatctgatggaaggtctgaatcttatgccgactccgtgaagggccgattcaccatctccagagacaattccaagaatacactatatcttcaaatgaacagtctgagacgtgaagacacggctgtctattactgtgcgactgagatgtcttattacgatgccagtggtttagtaccgttcgacccctggggccagggaaccctggtcaccgtctcctcagcttccaccaagggcccatcggtcttccccctggcgccctgctccaggagcacctctgggggcacagcggccctgggctgcctggtcaaggactacttcctcgtagcact

SEQ ID NO: 444888 - DNA, 521 bp, Homo sapiens
  misc_feature: HEFZJCU01D2P4L.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctgctccaggagcacctccg

SEQ ID NO: 444889 - DNA, 449 bp, Homo sapiens
  misc_feature: HEFZJCU01CNY4O.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttcccctggcgccctgctccaggagcacctccgagagcacagcggccctgggctgcctggtcaaggactacttccagacgtatca

SEQ ID NO: 444890 - DNA, 450 bp, Homo sapiens
  misc_feature: HEFZJCU01D3C43.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 444891 - DNA, 400 bp, Homo sapiens; identical to SEQ ID NO: 444452
  misc_feature: HEFZJCU01EZ3XW.47.24.C02.1.454.heavy.3.raw

SEQ ID NO: 444892 - DNA, 489 bp, Homo sapiens; identical to SEQ ID NO: 444591
  misc_feature: HEFZJCU01C0R5X.18.70.G04.1.454.heavy.3.raw

SEQ ID NO: 444893 - DNA, 450 bp, Homo sapiens
  misc_feature: HEFZJCU01C8GFS.53.57.F02.1.454.heavy.3.raw
cgcgtatacacacgaccggtgctcgatttagctcgatatagttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 444894 - DNA, 395 bp, Homo sapiens
  misc_feature: HEFZJCU01EYMFY.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaggactacttcctacgtgagct

SEQ ID NO: 444895 - DNA, 379 bp, Homo sapiens; identical to SEQ ID NO: 444450
  misc_feature: HEFZJCU01CA6NJ.47.77.G11.1.454.heavy.3.raw

SEQ ID NO: 444896 - DNA, 391 bp, Homo sapiens
  misc_feature: HEFZJCU01D6XOX.48.62.F07.1.454.heavy.3.raw
agtatacatacacgaccggtgctcgatttagtagtcgcataaagggaaaggggctggacgggatctcgggaattagtgctgctagtggtagcagtttatacgcagactccgtgaagggccgattcaccatctccagagacaattccaagaacacggcgtatctgcagatgaacaacctgggcgtcgaggacacggccatttattactgtgcgaaatcctctggccgtgccgctaggtactttgagcactggggtccgggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 444897 - DNA, 517 bp, Homo sapiens
  misc_feature: HEFZJCU01CI0EU.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 444898 - DNA, 456 bp, Homo sapiens
  misc_feature: HEFZJCU01BWIKO.10.38.D05.1.454.heavy.3.raw
catagtagtgcacgaccggtgctcgatttagtatctgatagttgggtttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 444899 - DNA, 513 bp, Homo sapiens
  misc_feature: HEFZJCU01CNQAE.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagcggtgtcgtttctaggtggctatttaaacgtgtcagtgtgaggtgcagctggtggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtgggtgatagaatttaccacacagactccgtgaagggccgcttcaccatctctagagacaattcccagaacacactgtatctgcaaatgactaggctgagagccgaacgacacggccatttattactgcgcgaaggataggttacggtcgacaacggtggctacgcgtttt

SEQ ID NO: 444900 - DNA, 396 bp, Homo sapiens; identical to SEQ ID NO: 444469
  misc_feature: HEFZJCU01C2137.47.46.E02.1.454.heavy.3.raw

SEQ ID NO: 444901 - DNA, 414 bp, Homo sapiens
  misc_feature: HEFZJCU01BLTSX.51.70.G04.1.454.heavy.3.raw
cgatcgtatacacgaccggtgctcgatttagtgtagtgtgaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 444902 - DNA, 417 bp, Homo sapiens
  misc_feature: HEFZJCU01AUN55.16.28.C06.1.454.heavy.3.raw
tgtactactccacgaccggtgctcgatttagagctcacgtattgggtttgggattgtctctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaaagggtactactttgactactggggccagggaaccctggtcaccgtctcctcagcctccaccaagggcccatcggtcttccccctggcgccctgctccaggagcacctccgagaacacagcggccctgggctgcctggtcaaggacacttccgagtagtaca

SEQ ID NO: 444903 - DNA, 506 bp, Homo sapiens
  misc_feature: HEFZJCU01BGS4U.49.37.D04.1.454.heavy.3.raw
agtcgagagacacgaccggtgctcgatttagtagcatactgttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattatgatgccagtgctttagtaccgttcgacccctggggccagggagccctggtcaccgtctcctcagcttccaccaagggcccatcggtcttcccctggcgccctgctccaggagcacctctgggggcacagcggccctgggctgcctggtcaaggactacttcctctctcg

SEQ ID NO: 444904 - DNA, 482 bp, Homo sapiens
  misc_feature: HEFZJCU01EOK59.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggactacttcctacgtgagct

SEQ ID NO: 444905 - DNA, 517 bp, Homo sapiens
  misc_feature: HEFZJCU01D8I1A.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaacctggtcaccgtctcctcagcctccaccaagggcccatcggtcttcccctggcaccctcctccaagagcacctctgggggcacagcggccctgggctgcctggtcaaggactacttccgagtagtacac

SEQ ID NO: 444906 - DNA, 395 bp, Homo sapiens; identical to SEQ ID NO: 444517
  misc_feature: HEFZJCU01DIFY8.16.68.G02.1.454.heavy.3.raw

SEQ ID NO: 444907 - DNA, 436 bp, Homo sapiens
  misc_feature: HEFZJCU01B0Z2L.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaaggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 444908 - DNA, 485 bp, Homo sapiens
  misc_feature: HEFZJCU01CHN7N.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttcccctggcgccctgctccaggagcacctccgagagcacagcggccctgggctgcctggtcaaggactacttcctacgtcgtat

SEQ ID NO: 444909 - DNA, 379 bp, Homo sapiens; identical to SEQ ID NO: 444450
  misc_feature: HEFZJCU01EDAWZ.47.77.G11.1.454.heavy.3.raw

SEQ ID NO: 444910 - DNA, 385 bp, Homo sapiens
  misc_feature: HEFZJCU01C9KPH.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacgaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 444911 - DNA, 489 bp, Homo sapiens; identical to SEQ ID NO: 444591
  misc_feature: HEFZJCU01ER0KW.18.70.G04.1.454.heavy.3.raw

SEQ ID NO: 444912 - DNA, 494 bp, Homo sapiens
  misc_feature: HEFZJCU01D3Y9Q.52.37.D04.1.454.heavy.3.raw
cgcagtacgacacgaccggtgctcgatttagtagcatactgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 444913 - DNA, 384 bp, Homo sapiens; identical to SEQ ID NO: 444454
  misc_feature: HEFZJCU01EDCNU.11.61.F06.1.454.heavy.3.raw

SEQ ID NO: 444914 - DNA, 400 bp, Homo sapiens; identical to SEQ ID NO: 444452
  misc_feature: HEFZJCU01CXBJB.47.24.C02.1.454.heavy.3.raw

SEQ ID NO: 444915 - DNA, 488 bp, Homo sapiens; identical to SEQ ID NO: 444617
  misc_feature: HEFZJCU01DY40J.4.6.A06.1.454.heavy.3.raw

SEQ ID NO: 444916 - DNA, 422 bp, Homo sapiens; identical to SEQ ID NO: 444734
  misc_feature: HEFZJCU01BNTPZ.16.78.H01.1.454.heavy.3.raw

SEQ ID NO: 444917 - DNA, 409 bp, Homo sapiens
  misc_feature: HEFZJCU01CBZ5Q.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcaccctcctccaagagcacctctgggggcacagcggccctgggctgcctggtcaaggactacttccgagtgcgtct

SEQ ID NO: 444918 - DNA, 316 bp, Homo sapiens; identical to SEQ ID NO: 444479
  misc_feature: HEFZJCU01ATPB4.47.84.H07.1.454.heavy.3.raw

SEQ ID NO: 444919 - DNA, 371 bp, Homo sapiens
  misc_feature: HEFZJCU01CYAF9.3.1.A01.1.454.heavy.3.raw
agacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 444920 - DNA, 432 bp, Homo sapiens
  misc_feature: HEFZJCU01APASW.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 444921 - DNA, 491 bp, Homo sapiens
  misc_feature: HEFZJCU01CTISM.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttctagtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtaatattactgtgacgaagatttggggaatgaacc

SEQ ID NO: 444922 - DNA, 482 bp, Homo sapiens
  misc_feature: HEFZJCU01CS504.11.23.C01.1.454.heavy.3.raw
cgagagataccacgaccggtgctcgatttagtacacgtgattagggattggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 444923 - DNA, 395 bp, Homo sapiens
  misc_feature: HEFZJCU01B0912.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444924 - DNA, 483 bp, Homo sapiens
  misc_feature: HEFZJCU01CINV2.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 444925 - DNA, 362 bp, Homo sapiens
  misc_feature: HEFZJCU01EOBW8.49.25.C03.1.454.heavy.3.raw
agtcgagagacacgaccggtgctcgatttagtagtgtagatttgggtttgggtgcccaagctgctggagggccggttcaccatctccagagacaattccaagaatatgctatttctgcaaatgaacagcctgagaatcgaggacacggccgtatattactgtgtgaaagaagatggaccgctggacgaggagccctacggcgggtcctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 444926 - DNA, 400 bp, Homo sapiens; identical to SEQ ID NO: 444452
  misc_feature: HEFZJCU01AVG93.47.24.C02.1.454.heavy.3.raw

SEQ ID NO: 444927 - DNA, 505 bp, Homo sapiens
  misc_feature: HEFZJCU01AQZL5.17.31.C09.1.454.heavy.3.raw
cgtagactagcacgaccggtgctcgatttagacgtctcatcaaggaaggaagggctgtagttgatgtgagagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttcccctggcaccctcctccaagagcacctctgggggcacagcggccctgggctgcctggtcaaggactacttccctagtctacg

SEQ ID NO: 444928 - DNA, 519 bp, Homo sapiens
  misc_feature: HEFZJCU01DHQHR.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccggggaacccgtggtcaccgtctcttcagcctccaccaagggcccatcggtcttcccctggcaccctcctccagagcacctctgggggcacagcc

SEQ ID NO: 444929 - DNA, 324 bp, Homo sapiens; identical to SEQ ID NO: 444475
  misc_feature: HEFZJCU01DZW50.18.17.B06.1.454.heavy.3.raw

SEQ ID NO: 444930 - DNA, 387 bp, Homo sapiens
  misc_feature: HEFZJCU01DKME5.16.59.F04.1.454.heavy.3.raw
tgtactactccacgaccggtgctcgatttagtacacacacttagggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttccccctggcaccctcctccaagagcacctctgggggcacagcggccctgggctgcctggtcaaggactacttccgagtagtaca

SEQ ID NO: 444931 - DNA, 522 bp, Homo sapiens
  misc_feature: HEFZJCU01DA6DP.12.40.D07.1.454.heavy.3.raw
atacgacgtacacgaccggtgctcgatttagtgatagagcgtaacaacagagggctcaccatggagtttgggctgagcgtggtttcgtcgtaggctctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 444932 - DNA, 483 bp, Homo sapiens
  misc_feature: HEFZJCU01CRQYW.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacg

SEQ ID NO: 444933 - DNA, 413 bp, Homo sapiens
  misc_feature: HEFZJCU01BS2GN.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 444934 - DNA, 397 bp, Homo sapiens; identical to SEQ ID NO: 444534
  misc_feature: HEFZJCU01ARF9M.18.1.A01.1.454.heavy.3.raw

SEQ ID NO: 444935 - DNA, 527 bp, Homo sapiens
  misc_feature: HEFZJCU01DLLW5.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttcccctggcaccctcctccaagagcacctctgggggcacagcggccctgggctgcctggtcaaggactacttccg

SEQ ID NO: 444936 - DNA, 394 bp, Homo sapiens; identical to SEQ ID NO: 444701
  misc_feature: HEFZJCU01AONMD.3.12.B01.1.454.heavy.3.raw

SEQ ID NO: 444937 - DNA, 336 bp, Homo sapiens; identical to SEQ ID NO: 444466
  misc_feature: HEFZJCU01DOSO9.19.74.G08.1.454.heavy.3.raw

SEQ ID NO: 444938 - DNA, 542 bp, Homo sapiens
  misc_feature: HEFZJCU01DMBMJ.52.57.F02.1.454.heavy.3.raw
cgcagtacgacacgaccggtgctcgatttagctcgatatagttgggtttgggctgagcgtggcgtctttacgttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagttttggagtggccaaagacggcaggttccgctacgggttggacgtctggggccaagggaccacggtcaccgtcgcctcagcctccaccaagggcccatcggtcttcccctggcaccctcctccaagag

SEQ ID NO: 444939 - DNA, 386 bp, Homo sapiens; identical to SEQ ID NO: 444449
  misc_feature: HEFZJCU01DYW3C.27.46.E02.1.454.heavy.3.raw

SEQ ID NO: 444940 - DNA, 379 bp, Homo sapiens; identical to SEQ ID NO: 444450
  misc_feature: HEFZJCU01C1X0Q.47.77.G11.1.454.heavy.3.raw

SEQ ID NO: 444941 - DNA, 467 bp, Homo sapiens
  misc_feature: HEFZJCU01CW4L0.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgtgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 444942 - DNA, 397 bp, Homo sapiens
  misc_feature: HEFZJCU01DH5OB.18.1.A01.1.454.heavy.3.raw
tacgagtatgcacgaccggtgctcgatttagacgtctcatcaagggagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctccttcaagagcacctctgggggcacagcggccctgggctgcctggtcaaggactacttcccatactcgta

SEQ ID NO: 444943 - DNA, 378 bp, Homo sapiens; identical to SEQ ID NO: 444463
  misc_feature: HEFZJCU01BQJ30.47.77.G11.1.454.heavy.3.raw

SEQ ID NO: 444944 - DNA, 438 bp, Homo sapiens
  misc_feature: HEFZJCU01AK32M.51.5.A05.1.454.heavy.3.raw
cgatcgtatacacgaccggtgctcgatttagatagatagacaggggccctcctggaagggacaggagcgcgcaagggtgagtcagaccctcctgccctcgatggcaggtggagaagattcagaaaggtctgagatccccgggacgcagcaccactgtcaatggggggccccagacgcctggaccagggcctgcgtgggaaaggcctctgggcacactcaggggctttttgtgaagggtccgcctactgtgtgactacggtaaatacgttaattcttctactacgatatggacgtctggggccaagggaccacggtcaccgtctcttcagcctccaccaagggcccatcggtcttccccctggcaccctcctccaagagcacctctgggggcacagcggccctgggctgcctggtcaaggactacttcctcgtagcact

SEQ ID NO: 444945 - DNA, 355 bp, Homo sapiens; identical to SEQ ID NO: 444443
  misc_feature: HEFZJCU01DRW1V.47.38.D05.1.454.heavy.3.raw

SEQ ID NO: 444946 - DNA, 383 bp, Homo sapiens; identical to SEQ ID NO: 444673
  misc_feature: HEFZJCU01CINAK.11.61.F06.1.454.heavy.3.raw

SEQ ID NO: 444947 - DNA, 480 bp, Homo sapiens
  misc_feature: HEFZJCU01BLCF1.22.36.D03.1.454.heavy.3.raw
acatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccagacgtatca

SEQ ID NO: 444948 - DNA, 412 bp, Homo sapiens
  misc_feature: HEFZJCU01BZ974.53.58.F03.1.454.heavy.3.raw
cgcgtatacacacgaccggtgctcgatttagtctgatcgagaagggaaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 444949 - DNA, 477 bp, Homo sapiens; identical to SEQ ID NO: 444659
  misc_feature: HEFZJCU01A9COM.16.10.A10.1.454.heavy.3.raw

SEQ ID NO: 444950 - DNA, 519 bp, Homo sapiens
  misc_feature: HEFZJCU01EXMQ4.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctcaccaaggcccatcggtcttcccctggcg

SEQ ID NO: 444951 - DNA, 512 bp, Homo sapiens
  misc_feature: HEFZJCU01B7OH8.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactt

SEQ ID NO: 444952 - DNA, 450 bp, Homo sapiens
  misc_feature: HEFZJCU01AIDOL.51.37.D04.1.454.heavy.3.raw
cgatcgtatacacgaccggtgctcgatttagtagcatactgttgggtttggggttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttggttttgggggaagaggaagactgacggtcccccaggagttcaggtgctgggcacagcggccctgggctgcctggtcaaggactacttcctcgtagcact

SEQ ID NO: 444953 - DNA, 413 bp, Homo sapiens; identical to SEQ ID NO: 444933
  misc_feature: HEFZJCU01DQZZD.51.60.F05.1.454.heavy.3.raw

SEQ ID NO: 444954 - DNA, 470 bp, Homo sapiens; identical to SEQ ID NO: 444866
  misc_feature: HEFZJCU01CARAB.4.36.D03.1.454.heavy.3.raw

SEQ ID NO: 444955 - DNA, 498 bp, Homo sapiens
  misc_feature: HEFZJCU01BND14.40.81.H04.1.454.heavy.3.raw
  modified_base (493)..(493): a, c, t, g, unknown or other
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgcctctgacgacacggccatgtattactgtggaagagacgttggtggctaccgcggggctggaacctcnggggg

SEQ ID NO: 444956 - DNA, 336 bp, Homo sapiens; identical to SEQ ID NO: 444510
  misc_feature: HEFZJCU01ALPQN.3.31.C09.1.454.heavy.3.raw

SEQ ID NO: 444957 - DNA, 481 bp, Homo sapiens
  misc_feature: HEFZJCU01CRBDR.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccaggggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 444958 - DNA, 371 bp, Homo sapiens; identical to SEQ ID NO: 444919
  misc_feature: HEFZJCU01AH02C.3.1.A01.1.454.heavy.3.raw

SEQ ID NO: 444959 - DNA, 400 bp, Homo sapiens; identical to SEQ ID NO: 444452
  misc_feature: HEFZJCU01BBMCE.47.24.C02.1.454.heavy.3.raw

SEQ ID NO: 444960 - DNA, 395 bp, Homo sapiens; identical to SEQ ID NO: 444517
  misc_feature: HEFZJCU01BW7F9.16.68.G02.1.454.heavy.3.raw

SEQ ID NO: 444961 - DNA, 531 bp, Homo sapiens
  misc_feature: HEFZJCU01CC3L8.4.71.G05.1.454.heavy.3.raw
agcactgtagcacgaccggtgctcgatttagtgtcgtcgcaagagagagggggaagaccgatgggcccttggtggaggcttggtgaagccggggggtcccgttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttcccta

SEQ ID NO: 444962 - DNA, 511 bp, Homo sapiens
  misc_feature: HEFZJCU01D2J5Y.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctggggccgtggcacctggtcactgtctcctcggcttccaccaagggcccatcgtcttcccctggcgcctgctccaggagcacctcgtgggggcacagcggcccg

SEQ ID NO: 444963 - DNA, 519 bp, Homo sapiens; identical to SEQ ID NO: 444867
  misc_feature: HEFZJCU01EVJPG.9.34.D01.1.454.heavy.3.raw

SEQ ID NO: 444964 - DNA, 455 bp, Homo sapiens
  misc_feature: HEFZJCU01DGH9X.15.28.C06.1.454.heavy.3.raw
tctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggcgccctgctccaggagcacctccgagagcacagcggccctgggctgcctggtcaaggactacttccgctacgtaga

SEQ ID NO: 444965 - DNA, 397 bp, Homo sapiens
  misc_feature: HEFZJCU01B4RID.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctggtcaccgtctcctcagcctccaccaagggcccatcggtcttccccctggcgccctgctccaggagcacctccgagagcacagcggccctgggctgcctggtcaaggactacttcctacagtgct

SEQ ID NO: 444966 - DNA, 380 bp, Homo sapiens
  misc_feature: HEFZJCU01ARWFJ.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctcgggcgtgcctggtcaaggactacttcctacgtgagct

SEQ ID NO: 444967 - DNA, 476 bp, Homo sapiens
  misc_feature: HEFZJCU01DDXA6.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctggggcacagcggccctgggctgcctggtcaaggactacttccgagtagtaca

SEQ ID NO: 444968 - DNA, 325 bp, Homo sapiens
  misc_feature: HEFZJCU01CS652.18.17.B06.1.454.heavy.3.raw
tacgagtatgcacgaccggtgctcgatttagtcgatagtgaagggccgagttcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 444969 - DNA, 335 bp, Homo sapiens; identical to SEQ ID NO: 444488
  misc_feature: HEFZJCU01C9CGP.51.45.E01.1.454.heavy.3.raw

SEQ ID NO: 444970 - DNA, 400 bp, Homo sapiens; identical to SEQ ID NO: 444452
  misc_feature: HEFZJCU01CEYFA.47.24.C02.1.454.heavy.3.raw

SEQ ID NO: 444971 - DNA, 403 bp, Homo sapiens; identical to SEQ ID NO: 444540
  misc_feature: HEFZJCU01CN36T.16.72.G06.1.454.heavy.3.raw

SEQ ID NO: 444972 - DNA, 386 bp, Homo sapiens
  misc_feature: HEFZJCU01CSS6P.27.46.E02.1.454.heavy.3.raw
agcgtcgtctcacgaccggtgctcgatttagactcatctacagggaaagggactggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtgtgaaagtccaagggccggaatactactttgactactggggccagggaaccctggtcaccgtctcctcagcttccaccaagggcccatccgtcttcccctggcgccctgctccaggagcacctccgagagcacagccgccctgggctgcctggtcaaggactacttccagacgacgct

SEQ ID NO: 444973 - DNA, 483 bp, Homo sapiens; identical to SEQ ID NO: 444639
  misc_feature: HEFZJCU01AD2Z2.11.23.C01.1.454.heavy.3.raw

SEQ ID NO: 444974 - DNA, 396 bp, Homo sapiens; identical to SEQ ID NO: 444469
  misc_feature: HEFZJCU01C48WW.47.46.E02.1.454.heavy.3.raw

SEQ ID NO: 444975 - DNA, 400 bp, Homo sapiens; identical to SEQ ID NO: 444452
  misc_feature: HEFZJCU01A823O.47.24.C02.1.454.heavy.3.raw

SEQ ID NO: 444976 - DNA, 492 bp, Homo sapiens; identical to SEQ ID NO: 444827
  misc_feature: HEFZJCU01DCTXB.4.28.C06.1.454.heavy.3.raw

SEQ ID NO: 444977 - DNA, 384 bp, Homo sapiens; identical to SEQ ID NO: 444454
  misc_feature: HEFZJCU01CG1GA.11.61.F06.1.454.heavy.3.raw

SEQ ID NO: 444978 - DNA, 396 bp, Homo sapiens; identical to SEQ ID NO: 444469
  misc_feature: HEFZJCU01AZA51.47.46.E02.1.454.heavy.3.raw

SEQ ID NO: 444979 - DNA, 477 bp, Homo sapiens; identical to SEQ ID NO: 444659
  misc_feature: HEFZJCU01A7XNM.16.10.A10.1.454.heavy.3.raw

SEQ ID NO: 444980 - DNA, 483 bp, Homo sapiens; identical to SEQ ID NO: 444532
  misc_feature: HEFZJCU01CK94C.47.59.F04.1.454.heavy.3.raw

SEQ ID NO: 444981 - DNA, 395 bp, Homo sapiens
  misc_feature: HEFZJCU01CJ4OM.48.60.F05.1.454.heavy.3.raw
agtatacatacacgaccggtgctcgatttagtacgtcatcagggaaagggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggacgtacttcctatgtatact

SEQ ID NO: 444982 - DNA, 414 bp, Homo sapiens
  misc_feature: HEFZJCU01DHFIM.5.23.C01.1.454.heavy.3.raw
atcagacacgcacgaccggtgctcgatttagtacacgtgattagggattgggcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 444983 - DNA, 378 bp, Homo sapiens; identical to SEQ ID NO: 444463
  misc_feature: HEFZJCU01CG8KR.47.77.G11.1.454.heavy.3.raw

SEQ ID NO: 444984 - DNA, 390 bp, Homo sapiens; identical to SEQ ID NO: 444541
  misc_feature: HEFZJCU01BER23.16.24.C02.1.454.heavy.3.raw

SEQ ID NO: 444985 - DNA, 413 bp, Homo sapiens
  misc_feature: HEFZJCU01EVSP9.4.36.D03.1.454.heavy.3.raw
agcactgtagcacgaccggtgctcgatttagctgcgtcacgatctctcttggggttgtctctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttccccctggcgccctgctccaggagcacctccgagagcacagcggccctgggctgcctggtcaaggactacttccctacagtgct

SEQ ID NO: 444986 - DNA, 313 bp, Homo sapiens; identical to SEQ ID NO: 444518
  misc_feature: HEFZJCU01AFDRE.7.10.A10.1.454.heavy.3.raw

SEQ ID NO: 444987 - DNA, 390 bp, Homo sapiens; identical to SEQ ID NO: 444541
  misc_feature: HEFZJCU01CRYAQ.16.24.C02.1.454.heavy.3.raw

SEQ ID NO: 444988 - DNA, 471 bp, Homo sapiens
  misc_feature: HEFZJCU01DA8RE.48.1.A01.1.454.heavy.3.raw
agtatacatacacgaccggtgctcgatttagacgtctcatcaaggaaggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgtggcacggactactggggccagggaaccctagtcaccgtctcctcagcctccaccaagggcccatcggtcttcccctggcgccctgctccaggagcacctccgagagcacagcggccctgggctgcctggtcaaggactacttcctatgtatact

SEQ ID NO: 444989 - DNA, 396 bp, Homo sapiens; identical to SEQ ID NO: 444469
  misc_feature: HEFZJCU01B4LHJ.47.46.E02.1.454.heavy.3.raw

SEQ ID NO: 444990 - DNA, 493 bp, Homo sapiens
  misc_feature: HEFZJCU01CIDN9.53.77.G11.1.454.heavy.3.raw
cgcgtatacacacgaccggtgctcgatttagctagtcactcaagggaaagggtgtacacctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctgggggccgagggaccacggtcaccgtctcctcagcctccaccaagggcccatcggtccttcccctggcgccctgctccaggagcacctccgagagcacagcggccctgggctgcctggtcaggactacttcctcgtactgcg

SEQ ID NO: 444991 - DNA, 496 bp, Homo sapiens
  misc_feature: HEFZJCU01CJ0RF.22.78.H01.1.454.heavy.3.raw
acatacgcgtcacgaccggtgctcgatttagtgtgagtagtttgggtttgggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttccccctggcaccctcctccaagagcacctctgggggcacagcggccctgggctgcctggtcaaggactacttccacgcgtatgt

SEQ ID NO: 444992 - DNA, 508 bp, Homo sapiens
  misc_feature: HEFZJCU01DR3IQ.3.17.B06.1.454.heavy.3.raw
agacgcactccacgaccggtgctcgatttagtcgatagtgaaggggagctctgagaggcgagcccaaggcccagaattcccgaggtgtttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaaggcagattcaccatctcaagagatgattcagagaactcactttatctgcaaatgaacagcctgagaaccgacgacacggccgtctattattgtgtcatagacctaggatacaacgac

SEQ ID NO: 444993 - DNA, 495 bp, Homo sapiens; identical to SEQ ID NO: 444618
  misc_feature: HEFZJCU01EREFZ.3.26.C04.1.454.heavy.3.raw

SEQ ID NO: 444994 - DNA, 391 bp, Homo sapiens
  misc_feature: HEFZJCU01BR1Y2.40.58.F03.1.454.heavy.3.raw
tctagcgactcacgaccggtgctcgatttagtctgatcgagaagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 444995 - DNA, 497 bp, Homo sapiens
  misc_feature: HEFZJCU01AJO8X.4.26.C04.1.454.heavy.3.raw
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgacccctggggccagggaacccatgtcaccgtctcctcagcctccaccaagggcccatcggtcttcccctggcgccctgctccaggagcacctccgagaacacagcggccctgggctgcctggtcaaggactacttccctacagtgct

SEQ ID NO: 444996 - DNA, 379 bp, Homo sapiens; identical to SEQ ID NO: 444450
  misc_feature: HEFZJCU01D8VJ0.47.77.G11.1.454.heavy.3.raw

SEQ ID NO: 444997 - DNA, 383 bp, Homo sapiens; identical to SEQ ID NO: 444477
  misc_feature: HEFZJCU01CLI6T.47.60.F05.1.454.heavy.3.raw

SEQ ID NO: 444998 - DNA, 318 bp, Homo sapiens
  misc_feature: HEFZJCU01COLHX.18.39.D06.1.454.heavy.3.raw
tacgagtatgcacgaccggtgctcgatttagtgacatctcgcagttctttgggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 444999 - DNA, 436 bp, Homo sapiens; identical to SEQ ID NO: 444686
  misc_feature: HEFZJCU01EIMAJ.40.27.C05.1.454.heavy.3.raw

SEQ ID NO: 445000 - DNA, 309 bp, Homo sapiens
  misc_feature: HEFZJCU01BX0CV.7.14.B03.1.454.heavy.3.raw
cgtgtctctacacgaccggtgctcgatttagtgtgagtagtttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacg

SEQ ID NO: 445001 - DNA, 402 bp, Homo sapiens; identical to SEQ ID NO: 444584
  misc_feature: HEFZJCU01ERT4B.10.77.G11.1.454.heavy.3.raw

SEQ ID NO: 445002 - DNA, 432 bp, Homo sapiens; identical to SEQ ID NO: 444920
  misc_feature: HEFZJCU01AWRE0.11.39.D06.1.454.heavy.3.raw

SEQ ID NO: 445003 - DNA, 375 bp, Homo sapiens; identical to SEQ ID NO: 444459
  misc_feature: HEFZJCU01CV2HG.48.59.F04.1.454.heavy.3.raw

SEQ ID NO: 445004 - DNA, 467 bp, Homo sapiens
  misc_feature: HEFZJCU01CVZB1.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 445005 - DNA, 395 bp, Homo sapiens; identical to SEQ ID NO: 444517
  misc_feature: HEFZJCU01D2MSO.16.68.G02.1.454.heavy.3.raw

SEQ ID NO: 445006 - DNA, 481 bp, Homo sapiens
  misc_feature: HEFZJCU01BP6II.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggccctgggctgcctggtcaaggactacttcctagagacacg

SEQ ID NO: 445007 - DNA, 486 bp, Homo sapiens
  misc_feature: HEFZJCU01DY4XZ.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttccactactatg

SEQ ID NO: 445008 - DNA, 380 bp, Homo sapiens
  misc_feature: HEFZJCU01BKUU7.2.86.H09.1.454.heavy.3.raw
acgctcgacacacgaccggtgctcgatttagtgctatagacttggggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgactttgactcctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 445009 - DNA, 385 bp, Homo sapiens; identical to SEQ ID NO: 444438
  misc_feature: HEFZJCU01ERG29.18.60.F05.1.454.heavy.3.raw

SEQ ID NO: 445010 - DNA, 532 bp, Homo sapiens
  misc_feature: HEFZJCU01CKGT1.4.71.G05.1.454.heavy.3.raw
agcactgtagcacgaccggtgctcgatttagtgtcgtcgcaagagagagggggaagaccgatgggcccttggtggaggcttggtgaagccggggggtcccgttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtacaaggactacttcccta

SEQ ID NO: 445011 - DNA, 480 bp, Homo sapiens
  misc_feature: HEFZJCU01BPOL0.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccacgcgtatgt

SEQ ID NO: 445012 - DNA, 497 bp, Homo sapiens
  misc_feature: HEFZJCU01BUR91.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggacttac

SEQ ID NO: 445013 - DNA, 518 bp, Homo sapiens
  misc_feature: HEFZJCU01C0GWO.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtac

SEQ ID NO: 445014 - DNA, 390 bp, Homo sapiens; identical to SEQ ID NO: 444541
  misc_feature: HEFZJCU01DKJT9.16.24.C02.1.454.heavy.3.raw

SEQ ID NO: 445015 - DNA, 524 bp, Homo sapiens
  misc_feature: HEFZJCU01AP3FT.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattactaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgt

SEQ ID NO: 445016 - DNA, 403 bp, Homo sapiens
  misc_feature: HEFZJCU01EVZLF.13.72.G06.1.454.heavy.3.raw
tcacgtactacacgaccggtgctcgatttagctacgactgcaagggaaaggggctgcagtgggtcgccactattggtgataatggcagaaacatttactacgcagactccgtgaggggccgcttcaccatctccagagacaattcacggaacacattgtttttacaaattgtcggcctgcgggccgaggacacggccaaatatttttgtgtaaaggatcaatataccagtttggttcgaagtccgtggccttttgactcctggggccagggaaccctggtcaccgtctcctcagcttccaccaagggcccatcggtcttccccctggcgccctgctccaggagcacctctgggggcacagcggccctgggctgcctggtcaaggactacttcctagtacgtga

SEQ ID NO: 445017 - DNA, 506 bp, Homo sapiens
  misc_feature: HEFZJCU01C5L9I.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctcgggctgcctggtcaaggactacttccacctacta

SEQ ID NO: 445018 - DNA, 483 bp, Homo sapiens; identical to SEQ ID NO: 444639
  misc_feature: HEFZJCU01C5YWT.11.23.C01.1.454.heavy.3.raw

SEQ ID NO: 445019 - DNA, 314 bp, Homo sapiens; identical to SEQ ID NO: 444774
  misc_feature: HEFZJCU01DE63S.7.10.A10.1.454.heavy.3.raw

SEQ ID NO: 445020 - DNA, 379 bp, Homo sapiens
  misc_feature: HEFZJCU01CRWPI.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcaaggacacggccgtatattattgtgttaaatgggatggtggctacgactcttggggccggggaaccctggtcaccgtctcttcagcttccaccaagggcccatcggtcttccccctggcgccctgctccaggagcacctccgagagcacagcggccctgggctgcctggtcaaggactacttcctacgtgagct

SEQ ID NO: 445021 - DNA, 500 bp, Homo sapiens; identical to SEQ ID NO: 444529
  misc_feature: HEFZJCU01C220V.12.38.D05.1.454.heavy.3.raw

SEQ ID NO: 445022 - DNA, 320 bp, Homo sapiens
  misc_feature: HEFZJCU01AFEBN.14.28.C06.1.454.heavy.3.raw
cgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 445023 - DNA, 499 bp, Homo sapiens
  misc_feature: HEFZJCU01B3C5Y.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagcgtggtttcgtgtaggctctttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggcc

SEQ ID NO: 445024 - DNA, 504 bp, Homo sapiens
  misc_feature: HEFZJCU01CHW0S.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactgggccagggaaccctggtcaccgtctcttcagcctccaccaagggcccatcggtctcccctggcaccctcctccaagagcacctctgggggcacagcggccctgggctgcctggtcaaggactacttcctagtacgtga

SEQ ID NO: 445025 - DNA, 374 bp, Homo sapiens; identical to SEQ ID NO: 444640
  misc_feature: HEFZJCU01EOX4O.7.37.D04.1.454.heavy.3.raw

SEQ ID NO: 445026 - DNA, 379 bp, Homo sapiens; identical to SEQ ID NO: 444450
  misc_feature: HEFZJCU01EXDBT.47.77.G11.1.454.heavy.3.raw

SEQ ID NO: 445027 - DNA, 501 bp, Homo sapiens
  misc_feature: HEFZJCU01D52K0.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 445028 - DNA, 500 bp, Homo sapiens
  misc_feature: HEFZJCU01AUOPB.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggccctgggctgcctggtcaaggactacttccgtactagacg

SEQ ID NO: 445029 - DNA, 403 bp, Homo sapiens
  misc_feature: HEFZJCU01CZIN1.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 445030 - DNA, 412 bp, Homo sapiens
  misc_feature: HEFZJCU01C4W8W.52.80.H03.1.454.heavy.3.raw
cgcagtacgacacgaccggtgctcgatttagctgtgcgtcgaagggaaaggggctggagttggtcgcgtcaattagttatagtggtaataacaagaattatgaagagtccgtgaagggccggttcaccatctccagagacaattccaagaacactctgtctctacaaatgaacagcctgagagccgaggacacggccgtatattactgtgcgtcgccaagcctattagcttggttcggggagttactgagagatccttcctttgatatctggggccaagggacaatggtcgtcgtctcttcagcctccaccaagggcccatcggtcttccccctggcaccctcctccaagagcacctctgggggcacagcggccctgggctgcctggtcaaggactacttcctatacgatcg

SEQ ID NO: 445031 - DNA, 481 bp, Homo sapiens; identical to SEQ ID NO: 445006
  misc_feature: HEFZJCU01D7JN6.7.10.A10.1.454.heavy.3.raw

SEQ ID NO: 445032 - DNA, 437 bp, Homo sapiens; identical to SEQ ID NO: 444603
  misc_feature: HEFZJCU01C6U2M.3.21.B10.1.454.heavy.3.raw

SEQ ID NO: 445033 - DNA, 399 bp, Homo sapiens
  misc_feature: HEFZJCU01DCTQO.4.79.H02.1.454.heavy.3.raw
agcactgtagcacgaccggtgctcgatttagtgtcacacgaagggaaaggggctggagtggctttcatacattgatagtagtgggaagatcatatactacgcagactctgtgaagggccgattcaccgtctccagagacaacaccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttccccctggcgccctgctccaggagcacctccgagagcacagcggccctgggctgcctggtcaaggactacttccctacagtgct

SEQ ID NO: 445034 - DNA, 505 bp, Homo sapiens; identical to SEQ ID NO: 444759
  misc_feature: HEFZJCU01EWQOE.10.38.D05.1.454.heavy.3.raw

SEQ ID NO: 445035 - DNA, 397 bp, Homo sapiens
  misc_feature: HEFZJCU01BSJJ9.51.58.F03.1.454.heavy.3.raw
cgatcgtatacacgaccggtgctcgatttagtctgatcgagaagggaaaggggctggagtggatcggagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 445036 - DNA, 378 bp, Homo sapiens; identical to SEQ ID NO: 444463
  misc_feature: HEFZJCU01BTGGY.47.77.G11.1.454.heavy.3.raw

SEQ ID NO: 445037 - DNA, 379 bp, Homo sapiens; identical to SEQ ID NO: 444450
  misc_feature: HEFZJCU01DIIS7.47.77.G11.1.454.heavy.3.raw

SEQ ID NO: 445038 - DNA, 312 bp, Homo sapiens; identical to SEQ ID NO: 444415
  misc_feature: HEFZJCU01ET01C.7.10.A10.1.454.heavy.3.raw

SEQ ID NO: 445039 - DNA, 399 bp, Homo sapiens
  misc_feature: HEFZJCU01A371F.13.4.A04.1.454.heavy.3.raw
tcacgtactacacgaccggtgctcgatttagagtagtgatcagggtccgccaggctccagggaagggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 445040 - DNA, 400 bp, Homo sapiens; identical to SEQ ID NO: 444452
  misc_feature: HEFZJCU01EMN7T.47.24.C02.1.454.heavy.3.raw

SEQ ID NO: 445041 - DNA, 432 bp, Homo sapiens; identical to SEQ ID NO: 444920
  misc_feature: HEFZJCU01B1RCP.11.39.D06.1.454.heavy.3.raw

SEQ ID NO: 445042 - DNA, 500 bp, Homo sapiens; identical to SEQ ID NO: 445028
  misc_feature: HEFZJCU01BYPKI.13.12.B01.1.454.heavy.3.raw

SEQ ID NO: 445043 - DNA, 338 bp, Homo sapiens
  misc_feature: HEFZJCU01DAKZS.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtggct

SEQ ID NO: 445044 - DNA, 368 bp, Homo sapiens; identical to SEQ ID NO: 444437
  misc_feature: HEFZJCU01EUS42.12.12.B01.1.454.heavy.3.raw

SEQ ID NO: 445045 - DNA, 395 bp, Homo sapiens; identical to SEQ ID NO: 444517
  misc_feature: HEFZJCU01DYIO6.16.68.G02.1.454.heavy.3.raw

SEQ ID NO: 445046 - DNA, 450 bp, Homo sapiens
  misc_feature: HEFZJCU01BJSQ5.53.35.D02.1.454.heavy.3.raw
cgcgtatacacacgaccggtgctcgatttagcacacgatagttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 445047 - DNA, 308 bp, Homo sapiens
  misc_feature: HEFZJCU01AMCVD.7.14.B03.1.454.heavy.3.raw
cgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacg

SEQ ID NO: 445048 - DNA, 395 bp, Homo sapiens; identical to SEQ ID NO: 444517
  misc_feature: HEFZJCU01BNOBY.16.68.G02.1.454.heavy.3.raw

SEQ ID NO: 445049 - DNA, 513 bp, Homo sapiens
  misc_feature: HEFZJCU01DFTRX.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcacc

SEQ ID NO: 445050 - DNA, 519 bp, Homo sapiens
  misc_feature: HEFZJCU01BAKDM.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggtcgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 445051 - DNA, 396 bp, Homo sapiens; identical to SEQ ID NO: 444568
  misc_feature: HEFZJCU01CPLBG.47.46.E02.1.454.heavy.3.raw

SEQ ID NO: 445052 - DNA, 406 bp, Homo sapiens
  misc_feature: HEFZJCU01BG8ON.13.77.G11.1.454.heavy.3.raw
tcacgtactacacgaccggtgctcgatttagctagtcactcaagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 445053 - DNA, 396 bp, Homo sapiens; identical to SEQ ID NO: 444433
  misc_feature: HEFZJCU01AH7B4.47.59.F04.1.454.heavy.3.raw

SEQ ID NO: 445054 - DNA, 513 bp, Homo sapiens
  misc_feature: HEFZJCU01EUAHI.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctgggggcctagggactacggtcaccgtctcctcagcctccaccaagggccatcggtcttcccctggca

SEQ ID NO: 445055 - DNA, 511 bp, Homo sapiens
  misc_feature: HEFZJCU01B9BJJ.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaggactacttccgagtgcgtct

SEQ ID NO: 445056 - DNA, 431 bp, Homo sapiens
  misc_feature: HEFZJCU01CB8KI.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctggggcacagcggccctgggctgcctggtcaaggactacttccgtatctctcg

SEQ ID NO: 445057 - DNA, 432 bp, Homo sapiens; identical to SEQ ID NO: 444920
  misc_feature: HEFZJCU01AHX10.11.39.D06.1.454.heavy.3.raw

SEQ ID NO: 445058 - DNA, 521 bp, Homo sapiens
  misc_feature: HEFZJCU01EF5MR.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttccccctggcgccctgctccaggagcacctccgagagcacagcggccctgggctgcctggtcaaggactactcctacg

SEQ ID NO: 445059 - DNA, 324 bp, Homo sapiens; identical to SEQ ID NO: 444475
  misc_feature: HEFZJCU01DW1Y1.18.17.B06.1.454.heavy.3.raw

SEQ ID NO: 445060 - DNA, 432 bp, Homo sapiens; identical to SEQ ID NO: 444920
  misc_feature: HEFZJCU01CWK7K.11.39.D06.1.454.heavy.3.raw

SEQ ID NO: 445061 - DNA, 375 bp, Homo sapiens; identical to SEQ ID NO: 444459
  misc_feature: HEFZJCU01AFHGV.48.59.F04.1.454.heavy.3.raw

SEQ ID NO: 445062 - DNA, 464 bp, Homo sapiens
  misc_feature: HEFZJCU01ALFYO.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 445063 - DNA, 502 bp, Homo sapiens; identical to SEQ ID NO: 444768
  misc_feature: HEFZJCU01DWBSM.21.70.G04.1.454.heavy.3.raw

SEQ ID NO: 445064 - DNA, 301 bp, Homo sapiens
  misc_feature: HEFZJCU01AMORL.18.17.B06.1.454.heavy.3.raw
tacgagtatgcacgaccggtgctcgatttagtcgatagtgaagggccgattcaccatctcagaagacaattccaggaacacattgttatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 445065 - DNA, 470 bp, Homo sapiens; identical to SEQ ID NO: 444866
  misc_feature: HEFZJCU01DEFSK.4.36.D03.1.454.heavy.3.raw

SEQ ID NO: 445066 - DNA, 404 bp, Homo sapiens
  misc_feature: HEFZJCU01AUXCT.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcctggtcaaggactacttcccgagtagtaca

SEQ ID NO: 445067 - DNA, 491 bp, Homo sapiens
  misc_feature: HEFZJCU01DKQJM.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctgggctgcctggtcaggactacttccctacagtgct

SEQ ID NO: 445068 - DNA, 482 bp, Homo sapiens
  misc_feature: HEFZJCU01AYKEQ.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggccctgggctgcctggtcaaggactacttccgtatctctcg

SEQ ID NO: 445069 - DNA, 489 bp, Homo sapiens; identical to SEQ ID NO: 444591
  misc_feature: HEFZJCU01EZJX8.18.70.G04.1.454.heavy.3.raw

SEQ ID NO: 445070 - DNA, 509 bp, Homo sapiens
  misc_feature: HEFZJCU01DUWJ6.12.14.B03.1.454.heavy.3.raw
atacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 445071 - DNA, 522 bp, Homo sapiens
  misc_feature: HEFZJCU01DISUW.22.11.A11.1.454.heavy.3.raw
acatacgcgtcacgaccggtgctcgatttagctacgactgcagggtgtacacctgtggttctcgggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattgactactggggccagggaaccctggtcaccgtctcctcagcctccaccaaggcccatcggtcttcccctggcgccctgctccac

SEQ ID NO: 445072 - DNA, 395 bp, Homo sapiens; identical to SEQ ID NO: 444517
  misc_feature: HEFZJCU01AJ4XW.16.68.G02.1.454.heavy.3.raw

SEQ ID NO: 445073 - DNA, 450 bp, Homo sapiens; identical to SEQ ID NO: 444890
  misc_feature: HEFZJCU01AKX7U.9.53.E09.1.454.heavy.3.raw

SEQ ID NO: 445074 - DNA, 422 bp, Homo sapiens; identical to SEQ ID NO: 444681
  misc_feature: HEFZJCU01ASG6M.16.78.H01.1.454.heavy.3.raw

SEQ ID NO: 445075 - DNA, 489 bp, Homo sapiens; identical to SEQ ID NO: 444791
  misc_feature: HEFZJCU01B20CA.47.85.H08.1.454.heavy.3.raw

SEQ ID NO: 445076 - DNA, 476 bp, Homo sapiens; identical to SEQ ID NO: 444967
  misc_feature: HEFZJCU01DQOQG.16.10.A10.1.454.heavy.3.raw

SEQ ID NO: 445077 - DNA, 487 bp, Homo sapiens
  misc_feature: HEFZJCU01BRYJW.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 445078 - DNA, 517 bp, Homo sapiens
  misc_feature: HEFZJCU01DHZU1.4.33.C11.1.454.heavy.3.raw
agcactgtagcacgaccggtgctcgatttagagtgagctcgttgggtttggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgttgttagggtagttttacgtatttttggtagtggatattaa

SEQ ID NO: 445079 - DNA, 402 bp, Homo sapiens; identical to SEQ ID NO: 444584
  misc_feature: HEFZJCU01AXQBA.10.77.G11.1.454.heavy.3.raw

SEQ ID NO: 445080 - DNA, 500 bp, Homo sapiens
  misc_feature: HEFZJCU01EY412.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccga

SEQ ID NO: 445081 - DNA, 468 bp, Homo sapiens
  misc_feature: HEFZJCU01C6X02.49.27.C05.1.454.heavy.3.raw
agtcgagagacacgaccggtgctcgatttagacgcgatcgaaggggtccgggagatcatgagggtgtccttgggttttgggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggcccccctttccaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 445082 - DNA, 483 bp, Homo sapiens; identical to SEQ ID NO: 444924
  misc_feature: HEFZJCU01D64JX.10.35.D02.1.454.heavy.3.raw

SEQ ID NO: 445083 - DNA, 508 bp, Homo sapiens
  misc_feature: HEFZJCU01A8ZBC.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggcc

SEQ ID NO: 445084 - DNA, 396 bp, Homo sapiens; identical to SEQ ID NO: 444469
  misc_feature: HEFZJCU01D55JF.47.46.E02.1.454.heavy.3.raw

SEQ ID NO: 445085 - DNA, 396 bp, Homo sapiens; identical to SEQ ID NO: 444469
  misc_feature: HEFZJCU01E22KH.47.46.E02.1.454.heavy.3.raw

SEQ ID NO: 445086 - DNA, 352 bp, Homo sapiens
  misc_feature: HEFZJCU01BOAAO.12.28.C06.1.454.heavy.3.raw
atacgacgtacacgaccggtgctcgatttagagctcacgtattgggtttgggcttcacaggccgctttgtcttctccttggacacctctgtcagtacgtcatatctgcaaatcaacgccctaaggactgccgacactgccatttatttctgtgcgagatatacagcccaccccgatatcgcggcagttgccagggggacacttgactactggggccagggaaccctagtcgccgtctcctcagcctccaccaagggcccatcggtcttccccctggcaccctcctccaagagcacctctgggggcacagcggccctgggctgcctggtcaaggactacttcctacgtcgtat

SEQ ID NO: 445087 - DNA, 392 bp, Homo sapiens; identical to SEQ ID NO: 444456
  misc_feature: HEFZJCU01AIARF.7.60.F05.1.454.heavy.3.raw

SEQ ID NO: 445088 - DNA, 320 bp, Homo sapiens; identical to SEQ ID NO: 445022
  misc_feature: HEFZJCU01C01KA.14.28.C06.1.454.heavy.3.raw

SEQ ID NO: 445089 - DNA, 379 bp, Homo sapiens; identical to SEQ ID NO: 444450
  misc_feature: HEFZJCU01AKWWC.47.77.G11.1.454.heavy.3.raw

SEQ ID NO: 445090 - DNA, 470 bp, Homo sapiens; identical to SEQ ID NO: 444866
  misc_feature: HEFZJCU01BE1AZ.4.36.D03.1.454.heavy.3.raw

SEQ ID NO: 445091 - DNA, 395 bp, Homo sapiens; identical to SEQ ID NO: 444517
  misc_feature: HEFZJCU01DLYI2.16.68.G02.1.454.heavy.3.raw

SEQ ID NO: 445092 - DNA, 483 bp, Homo sapiens; identical to SEQ ID NO: 444924
  misc_feature: HEFZJCU01A2RKB.10.35.D02.1.454.heavy.3.raw

SEQ ID NO: 445093 - DNA, 380 bp, Homo sapiens
  misc_feature: HEFZJCU01DI1RL.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccgggagccctggtcaccgtctcctcagcctccaccaagggcccatcggtcttccccctggcgccctgctccaggagcacctccgagagcacagcggccctgggctgcctggtcaaggactacttcccacgta

SEQ ID NO: 445094 - DNA, 496 bp, Homo sapiens
  misc_feature: HEFZJCU01DAF9Z.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggca

SEQ ID NO: 445095 - DNA, 450 bp, Homo sapiens
  misc_feature: HEFZJCU01B0GBX.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggtcgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 445096 - DNA, 335 bp, Homo sapiens
  misc_feature: HEFZJCU01ESAYO.14.28.C06.1.454.heavy.3.raw
cgtctagtaccacgaccggtgctcgatttagagctcacgtattgggtttgggtgccgaagttgctggaggtcacggtcaccacgctgctgagggagtagagtcctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtacagacg

SEQ ID NO: 445097 - DNA, 378 bp, Homo sapiens
  misc_feature: HEFZJCU01DB8QC.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattccgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 445098 - DNA, 392 bp, Homo sapiens
  misc_feature: HEFZJCU01DNA89.4.42.D09.1.454.heavy.3.raw
agcactgtagcacgaccggtgctcgatttagacacatacgcagggaaaggggctggaatgggtggcaattgtctcctatgatggaagtaaaaatattatgcagactccgtgaagggccggtttatcatctccagagacaattacagggataccctatctttgcaaatgaataacgtgacagatgacgacacggctgtctactactgtgcgaggagccgttggtttgactatgataatggcatggatgtctggggccaagggaccacggtcaccgtgtcttcagcctccaccaagggcccatcggtcttccccctggcaccctcctccaagagcacctctgggggcacagcggccctgggctgcctggtcaaggactacttccctacagtgct

SEQ ID NO: 445099 - DNA, 314 bp, Homo sapiens; identical to SEQ ID NO: 444774
  misc_feature: HEFZJCU01BSBIF.7.10.A10.1.454.heavy.3.raw

SEQ ID NO: 445100 - DNA, 494 bp, Homo sapiens
  misc_feature: HEFZJCU01AIWH7.52.53.E09.1.454.heavy.3.raw
cgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 445101 - DNA, 379 bp, Homo sapiens; identical to SEQ ID NO: 444450
  misc_feature: HEFZJCU01C4UWF.47.77.G11.1.454.heavy.3.raw

SEQ ID NO: 445102 - DNA, 491 bp, Homo sapiens; identical to SEQ ID NO: 444803
  misc_feature: HEFZJCU01D6RKA.4.57.F02.1.454.heavy.3.raw

SEQ ID NO: 445103 - DNA, 508 bp, Homo sapiens
  misc_feature: HEFZJCU01C517S.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagactatgtggactctgtgaagggccgattcaccatctccagagacaacgccaagaactcactgtatctgcaaatgaacagcctaagacccgaggacacggctgtgtattactgtgcgagagaccgctactggggcccgggagcccctggt

SEQ ID NO: 445104 - DNA, 519 bp, Homo sapiens
  misc_feature: HEFZJCU01DI8FV.12.71.G05.1.454.heavy.3.raw
  modified_base (465)..(465): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttcccctggcgccctgctccaggngcacctccgagagcacagcggccctgggctgcctggtcaggactacttcctacg

SEQ ID NO: 445105 - DNA, 396 bp, Homo sapiens; identical to SEQ ID NO: 444469
  misc_feature: HEFZJCU01AO81V.47.46.E02.1.454.heavy.3.raw

SEQ ID NO: 445106 - DNA, 482 bp, Homo sapiens
  misc_feature: HEFZJCU01D40PO.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaggactacttcccactactatg

SEQ ID NO: 445107 - DNA, 531 bp, Homo sapiens
  misc_feature: HEFZJCU01CHBTF.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttcccctggcaccctcctccaagagcacctct

SEQ ID NO: 445108 - DNA, 391 bp, Homo sapiens; identical to SEQ ID NO: 444994
  misc_feature: HEFZJCU01C0SZQ.40.58.F03.1.454.heavy.3.raw

SEQ ID NO: 445109 - DNA, 325 bp, Homo sapiens
  misc_feature: HEFZJCU01DZB4S.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 445110 - DNA, 396 bp, Homo sapiens; identical to SEQ ID NO: 444469
  misc_feature: HEFZJCU01D25TD.47.46.E02.1.454.heavy.3.raw

SEQ ID NO: 445111 - DNA, 416 bp, Homo sapiens
  misc_feature: HEFZJCU01A91NY.14.38.D05.1.454.heavy.3.raw
cgtctagtaccacgaccggtgctcgatttagtatctgatagttgggtccgccagcccccagggaaggggctggagtggattggacaaatctatcgtagtgggagcaccaactacaacccgtccctcaagactcgagtcaccatatcaatagacacatccaagaatcaattctccctgaagctgagctctgtgaccgccgcggacacggccgtctactactgtgcgagaacaatcggtgctacgctttttggagtgaacggctggttcgacccctggggccagggaacccaggtcaccgtctcctcagcctccaccaagggcccatcggtcttccccctggcaccctcctccaagagcacctctgggggcacagcggccctgggctgcctggtcaaggactacttccgtactagacg

SEQ ID NO: 445112 - DNA, 532 bp, Homo sapiens
  misc_feature: HEFZJCU01ECJT3.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgtatcacttgactcctgggccagggaaccctggtcagcgtctcttcagcctccaccaaggcccatcggtcttcccctggcaccctcctccagagcacctctgggggcacagcggccctgggctgcct

SEQ ID NO: 445113 - DNA, 482 bp, Homo sapiens; identical to SEQ ID NO: 444503
  misc_feature: HEFZJCU01DMU4M.7.10.A10.1.454.heavy.3.raw

SEQ ID NO: 445114 - DNA, 379 bp, Homo sapiens
  misc_feature: HEFZJCU01EDU78.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgctctgctccaggagcacctctgggggcacagcggccctgggctgcctggtcaaggactacttcctacgtgagct

SEQ ID NO: 445115 - DNA, 519 bp, Homo sapiens
  misc_feature: HEFZJCU01BZU1B.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggccaccctcctccaagagcacctctgggggcacagcggccctgggctgcctggtcaaggactacttccgagtagtaca

SEQ ID NO: 445116 - DNA, 395 bp, Homo sapiens
  misc_feature: HEFZJCU01D8YXI.40.38.D05.1.454.heavy.3.raw
tctagcgactcacgaccggtgctcgatttagtatctgatagttgggtttgggtgcccaagctgctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaaagtgttttatccctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 445117 - DNA, 528 bp, Homo sapiens
  misc_feature: HEFZJCU01B3CAU.40.81.H04.1.454.heavy.3.raw
tctagcgactcacgaccggtgctcgatttagtagtgtagattcgcgggtgtccttgggttttggggggaagaggaagactgacggtcctgccacagctggtgcagtctgtggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctcgctccaggagcacctcctggggcgacacgcggccgtcggcgtcg

SEQ ID NO: 445118 - DNA, 508 bp, Homo sapiens
  misc_feature: HEFZJCU01CQ5LA.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctggggcacagcggccctgggctgcctggtcaggactactcccata

SEQ ID NO: 445119 - DNA, 437 bp, Homo sapiens
  misc_feature: HEFZJCU01B8ZAZ.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctggtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 445120 - DNA, 385 bp, Homo sapiens; identical to SEQ ID NO: 444438
  misc_feature: HEFZJCU01CW0RP.18.60.F05.1.454.heavy.3.raw

SEQ ID NO: 445121 - DNA, 403 bp, Homo sapiens
  misc_feature: HEFZJCU01BXX5G.53.61.F06.1.454.heavy.3.raw
cgcgtatacacacgaccggtgctcgatttagctacgctctaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccattttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 445122 - DNA, 505 bp, Homo sapiens
  misc_feature: HEFZJCU01BZK1Q.49.31.C09.1.454.heavy.3.raw
agtcgagagacacgaccggtgctcgatttagacgtctcatcaaggaaggaagggacctcaggggtccgggagatcatgagggtgtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgcttttgatgtctggggccaagggacaatggtcaccgtctcttcagcctccaccaagggcccatcggtcttcccctggcaccctcctccaagagcacctctgggggcacagcggccctgggctgcctggtcaaggactacttcctctctcgact

SEQ ID NO: 445123 - DNA, 330 bp, Homo sapiens
  misc_feature: HEFZJCU01C43XH.48.30.C08.1.454.heavy.3.raw
agtatacatacacgaccggtgctcgatttagtctgacgtcaaagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 445124 - DNA, 396 bp, Homo sapiens; identical to SEQ ID NO: 444469
  misc_feature: HEFZJCU01BAMYN.47.46.E02.1.454.heavy.3.raw

SEQ ID NO: 445125 - DNA, 375 bp, Homo sapiens
  misc_feature: HEFZJCU01D2DRE.9.53.E09.1.454.heavy.3.raw
tgatacgtctcacgaccggtgctcgatttagagagagtgtgttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 445126 - DNA, 334 bp, Homo sapiens
  misc_feature: HEFZJCU01D8P89.49.14.B03.1.454.heavy.3.raw
agtcgagagacacgaccggtgctcgatttagtgtgagtagttccgcgggcacgaccggtgctcgatttagtgtgagtagtttgggtttggggcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 445127 - DNA, 372 bp, Homo sapiens; identical to SEQ ID NO: 444727
  misc_feature: HEFZJCU01EVIG4.3.42.D09.1.454.heavy.3.raw

SEQ ID NO: 445128 - DNA, 487 bp, Homo sapiens
  misc_feature: HEFZJCU01DEUNW.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggtcggttctccatctccagagacacttccaagaacacggtgtatctgcaagtgcacagcctgagagccgaggacacggccatatattactgtgcgaaagatcgattccccctccgtagagatggctacaaaatcttctccgaattgacttctggggccagggaaccctggtcaccgtctcctcagcctccaccaagggcccatcggtcttccccctggcaccctcctccaagagcacctctgggggcacagcggccctgggctgcctggtcaaggactactccgagtagtaca

SEQ ID NO: 445129 - DNA, 402 bp, Homo sapiens; identical to SEQ ID NO: 444815
  misc_feature: HEFZJCU01APBIO.11.70.G04.1.454.heavy.3.raw

SEQ ID NO: 445130 - DNA, 398 bp, Homo sapiens; identical to SEQ ID NO: 444524
  misc_feature: HEFZJCU01AXJ90.7.60.F05.1.454.heavy.3.raw

SEQ ID NO: 445131 - DNA, 400 bp, Homo sapiens
  misc_feature: HEFZJCU01AYP5H.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctacgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 445132 - DNA, 465 bp, Homo sapiens
  misc_feature: HEFZJCU01ESTFY.5.86.H09.1.454.heavy.3.raw
atcagacacgcacgaccggtgctcgatttagtgctatagacttgggtttgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatcggtcttccccctggcgccctgctccaggagcacctccgagagcacagcggccctgggctgcctggtcaaggactacttcccgtgtctgat

SEQ ID NO: 445133 - DNA, 432 bp, Homo sapiens; identical to SEQ ID NO: 444920
  misc_feature: HEFZJCU01EN22W.11.39.D06.1.454.heavy.3.raw

SEQ ID NO: 445134 - DNA, 513 bp, Homo sapiens
  misc_feature: HEFZJCU01B2D4V.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 445135 - DNA, 464 bp, Homo sapiens; identical to SEQ ID NO: 444693
  misc_feature: HEFZJCU01BXQTW.9.30.C08.1.454.heavy.3.raw

SEQ ID NO: 445136 - DNA, 480 bp, Homo sapiens; identical to SEQ ID NO: 444657
  misc_feature: HEFZJCU01EK9Y0.19.67.G01.1.454.heavy.3.raw

SEQ ID NO: 445137 - DNA, 503 bp, Homo sapiens; identical to SEQ ID NO: 444557
  misc_feature: HEFZJCU01EGRWY.9.33.C11.1.454.heavy.3.raw

SEQ ID NO: 445138 - DNA, 475 bp, Homo sapiens
  misc_feature: HEFZJCU01EWW8F.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 445139 - DNA, 490 bp, Homo sapiens
  misc_feature: HEFZJCU01D1E20.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactcctggggccagggaaccctggtcaccgtctcct

SEQ ID NO: 445140 - DNA, 390 bp, Homo sapiens; identical to SEQ ID NO: 444541
  misc_feature: HEFZJCU01DDF0Y.16.24.C02.1.454.heavy.3.raw

SEQ ID NO: 445141 - DNA, 396 bp, Homo sapiens
  misc_feature: HEFZJCU01D1XBL.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctataggcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactactcctacgtgagct

SEQ ID NO: 445142 - DNA, 386 bp, Homo sapiens
  misc_feature: HEFZJCU01CY4XM.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcactagcggccctgggctgcctggtcaaggactacttcccatactcgta

SEQ ID NO: 445143 - DNA, 385 bp, Homo sapiens
  misc_feature: HEFZJCU01D7EJL.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 445144 - DNA, 394 bp, Homo sapiens
  misc_feature: HEFZJCU01A0DBL.3.12.B01.1.454.heavy.3.raw
agacgcactccacgaccggtgctcgatttagtagtgtagattccgccggttgtagtcggtgctcccaccatagtgggagcaccgactacaacccgtccctcaagagtcgagtcaccatatcagtagacacgtccaagaatcagatctccctgaacgtgacctctgtgacggccgcagacacggccgtctattactgtgccagttcgtcacatatgcttacgtctgggggagatatcgttttctctgacaactggggccagggttccctggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 445145 - DNA, 375 bp, Homo sapiens; identical to SEQ ID NO: 444458
  misc_feature: HEFZJCU01DBVEO.13.78.H01.1.454.heavy.3.raw

SEQ ID NO: 445146 - DNA, 386 bp, Homo sapiens
  misc_feature: HEFZJCU01DZ2W0.16.77.G11.1.454.heavy.3.raw
tgtactactccacgaccggtgctcgatttagctagtcactcaagggaagggcctggagtggattgcgactatgtaccatagtgggagcacttactacaacccgtccctcaggagtcgagtcaccacatccgtagacacgtccacgaaccagttctccctgaggctgagctctgtgaccgccgcagacacggctgtttattactgtgtgagacattttcgttttgttatgcggggagttgactactggggccagggaacccgagtcaccgtctcctcagcctccaccaagggcccatcggtcttcccctggcaccctcctccaagagcacctctgggggcacagcggccctgggctgcctggtcaaggactacttccgagtagtaca

SEQ ID NO: 445147 - DNA, 483 bp, Homo sapiens; identical to SEQ ID NO: 444924
  misc_feature: HEFZJCU01DB8B7.10.35.D02.1.454.heavy.3.raw

SEQ ID NO: 445148 - DNA, 477 bp, Homo sapiens; identical to SEQ ID NO: 444659
  misc_feature: HEFZJCU01CN6TZ.16.10.A10.1.454.heavy.3.raw

SEQ ID NO: 445149 - DNA, 396 bp, Homo sapiens
  misc_feature: HEFZJCU01BHXJE.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcaccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 445150 - DNA, 438 bp, Homo sapiens
  misc_feature: HEFZJCU01CTSGL.13.38.D05.1.454.heavy.3.raw
tcacgtactacacgaccggtgctcgatttagtatctgatagttgggtttgggctcaactttcttgtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactactggggcccgggaagcctagtcagcgtctcctcagcctccaccaagggcccatcggtcttccccctggcaccctcctccaagagcacctctgggggcacagtggccctgggctgcctggtcaaggactacttccgtactagacg

SEQ ID NO: 445151 - DNA, 312 bp, Homo sapiens
  misc_feature: HEFZJCU01CHUD1.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtataacttggatagaagtgcttattacattgactactggggccagggaaccctcgtcaccgtctcctcagcctccaccaagggcccatcggtcttccccctggcaccctcctccaagagcacctctggggcacagcggacctgggctgcctggtcaaggactacttcctagagacacg

SEQ ID NO: 445152 - DNA, 423 bp, Homo sapiens; identical to SEQ ID NO: 444772
  misc_feature: HEFZJCU01EPBV1.16.78.H01.1.454.heavy.3.raw

SEQ ID NO: 445153 - DNA, 487 bp, Homo sapiens
  misc_feature: HEFZJCU01DJKYU.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgttcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttcccactactatg

SEQ ID NO: 445154 - DNA, 476 bp, Homo sapiens
  misc_feature: HEFZJCU01CCOMU.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 445155 - DNA, 396 bp, Homo sapiens; identical to SEQ ID NO: 444469
  misc_feature: HEFZJCU01BRCCL.47.46.E02.1.454.heavy.3.raw

SEQ ID NO: 445156 - DNA, 506 bp, Homo sapiens
  misc_feature: HEFZJCU01CB1J4.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 445157 - DNA, 509 bp, Homo sapiens
  misc_feature: HEFZJCU01C7ZPV.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctgggttccgcggtccgggt

SEQ ID NO: 445158 - DNA, 385 bp, Homo sapiens
  misc_feature: HEFZJCU01DQZRP.27.46.E02.1.454.heavy.3.raw
agcgtcgtctcacgaccggtgctcgatttagactcatctacagggaagggactggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtgtgaaagtccaagggccggaatactactttgactactggggccagggaaccctggtcaccgtctcctcagcttccaccaagggcccatccgtcttcccctggcgccctgctccaggagcacctccgagagcacagccgccctgggctgcctggtcaaggactacttccagacgacgct

SEQ ID NO: 445159 - DNA, 467 bp, Homo sapiens
  misc_feature: HEFZJCU01C8H6O.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcggccctgggctgcctggtcaaggactacttcctatgtatact

SEQ ID NO: 445160 - DNA, 400 bp, Homo sapiens; identical to SEQ ID NO: 444452
  misc_feature: HEFZJCU01C88PJ.47.24.C02.1.454.heavy.3.raw

SEQ ID NO: 445161 - DNA, 520 bp, Homo sapiens
  misc_feature: HEFZJCU01BZCIJ.12.40.D07.1.454.heavy.3.raw
  modified_base (463)..(463): a, c, t, g, unknown or other
atacgacgtacacgaccggtgctcgatttagtgatagagcgtaacaacagagggctcaccatggagtttgggctgagcgtggtttcgtcgttaggcgtctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacgggctgtctattattgcgcgagagagacacacgaacctactggccaatactatgggggcttgttctggggccnggggaccctggtcatcgtctcccagcctcaccaagggcccatcggcttcccctggcg

SEQ ID NO: 445162 - DNA, 503 bp, Homo sapiens
  misc_feature: HEFZJCU01DWEGO.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttccccctggcgccctgctccaggagcacctccgagagcacagcggccctgggctgcctggtcaaggactacttcccgagcgacga

SEQ ID NO: 445163 - DNA, 379 bp, Homo sapiens; identical to SEQ ID NO: 444450
  misc_feature: HEFZJCU01CG5FH.47.77.G11.1.454.heavy.3.raw

SEQ ID NO: 445164 - DNA, 477 bp, Homo sapiens; identical to SEQ ID NO: 444659
  misc_feature: HEFZJCU01A1ZIK.16.10.A10.1.454.heavy.3.raw

SEQ ID NO: 445165 - DNA, 507 bp, Homo sapiens
  misc_feature: HEFZJCU01D752D.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagcgtgtcgtttctaggtcggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggcacggccgtatattactgtgcgaaacgccaagatttttggagtggttattatacctttgacttcg

SEQ ID NO: 445166 - DNA, 499 bp, Homo sapiens
  misc_feature: HEFZJCU01DK0OE.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggccatcggtcttcccctggcgccctgctccaggagcacctccgagagcacagcggccctgggctgcctggtcaaggactacttccagacgtatca

SEQ ID NO: 445167 - DNA, 341 bp, Homo sapiens
  misc_feature: HEFZJCU01DX0VE.49.24.C02.1.454.heavy.3.raw
agtcgagagacacgaccggtgctcgatttagtacagatcgttagggaaagggccgattcatcatctccagagacaactccgagaacacgctgtatctgcaaatgaacaggctgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggccaccctcctccaagagcacctctgggggcacagcggccctgggctgcctggtcaaggactacttcctctctcgact

SEQ ID NO: 445168 - DNA, 378 bp, Homo sapiens; identical to SEQ ID NO: 444419
  misc_feature: HEFZJCU01AKE54.47.77.G11.1.454.heavy.3.raw

SEQ ID NO: 445169 - DNA, 391 bp, Homo sapiens
  misc_feature: HEFZJCU01EIMCO.40.41.D08.1.454.heavy.3.raw
tctagcgactcacgaccggtgctcgatttagtcacgcgagaaagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 445170 - DNA, 387 bp, Homo sapiens
  misc_feature: HEFZJCU01D4TYU.27.46.E02.1.454.heavy.3.raw
agcgtcgtctcacgaccggtgctcgatttagactcatctacagggaaagggactggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtgtgaaagtccaagggccggaatactactttgactactggggccagggaaccctggtcaccgtctcctcagcttccaccaagggcccatccgtcttccccctggcgccctgctccaggagcacctccgagagcacagccgccctgggctgcctggtcaaggactacttccagacgacgct

SEQ ID NO: 445171 - DNA, 339 bp, Homo sapiens; identical to SEQ ID NO: 444436
  misc_feature: HEFZJCU01CPT1K.47.38.D05.1.454.heavy.3.raw

SEQ ID NO: 445172 - DNA, 400 bp, Homo sapiens; identical to SEQ ID NO: 444452
  misc_feature: HEFZJCU01CCKZJ.47.24.C02.1.454.heavy.3.raw

SEQ ID NO: 445173 - DNA, 489 bp, Homo sapiens; identical to SEQ ID NO: 444591
  misc_feature: HEFZJCU01DERIY.18.70.G04.1.454.heavy.3.raw

SEQ ID NO: 445174 - DNA, 505 bp, Homo sapiens; identical to SEQ ID NO: 444759
  misc_feature: HEFZJCU01EFMPE.10.38.D05.1.454.heavy.3.raw

SEQ ID NO: 445175 - DNA, 506 bp, Homo sapiens; identical to SEQ ID NO: 444696
  misc_feature: HEFZJCU01BG2B8.16.34.D01.1.454.heavy.3.raw

SEQ ID NO: 445176 - DNA, 516 bp, Homo sapiens
  misc_feature: HEFZJCU01AYC1R.14.66.F11.1.454.heavy.3.raw
cgtctagtaccacgaccggtgctcgatttagtcacgcgagaagggtgccagggggaagaccgatgggcccaggactggtgaagccttcggagaccctgtccctcacctgcactgtctctggcggctccatcaatacttacaactggacctggatccggcagcccccagggaagggtctgaattggattgggtatatctctaacagtgggaggaccaactacaacccctccctccagagtcgagtcaccatttcattagacacgtccaagaaccagttctccctgaggttgaactctgtgaccgctgcggacacggccgtgtattattgtgcgagggtcggtggccacaatggcgagtacaactggttcgacccctggggccagggaaccctggtcaccgtctcctcagcctccaccaagggcccatcggtcttcccctggcaccctcctccaagagcacctctgggggcacagcggccctgggctgcctggtcaaggactacttccgtactagacg

SEQ ID NO: 445177 - DNA, 406 bp, Homo sapiens
  misc_feature: HEFZJCU01EH0KN.51.77.G11.1.454.heavy.3.raw
cgatcgtatacacgaccggtgctcgatttagctagtcactcaagggaaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 445178 - DNA, 324 bp, Homo sapiens
  misc_feature: HEFZJCU01CTPTO.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccggggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 445179 - DNA, 497 bp, Homo sapiens
  misc_feature: HEFZJCU01DDCCT.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacagcggccctgggctgcctggtcaaggactacttcctacgtcgtat

SEQ ID NO: 445180 - DNA, 538 bp, Homo sapiens
  misc_feature: HEFZJCU01CKANS.22.34.D01.1.454.heavy.3.raw
acatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccaccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctggggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 445181 - DNA, 503 bp, Homo sapiens; identical to SEQ ID NO: 444557
  misc_feature: HEFZJCU01EJQ47.9.33.C11.1.454.heavy.3.raw

SEQ ID NO: 445182 - DNA, 388 bp, Homo sapiens
  misc_feature: HEFZJCU01BNRU7.51.49.E05.1.454.heavy.3.raw
cgatcgtatacacgaccggtgctcgatttagagcgactagcaacacacaaaggggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggcccatcggtcttccccctggcaccctcctccaagagcacctctgggggcacagcggccctgggctgcctggtcaaggactacttcctcgtagcact

SEQ ID NO: 445183 - DNA, 426 bp, Homo sapiens
  misc_feature: HEFZJCU01D2UDM.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggccctgggctgcctggtcaaggactacttccactaga

SEQ ID NO: 445184 - DNA, 396 bp, Homo sapiens; identical to SEQ ID NO: 444469
  misc_feature: HEFZJCU01E0Y21.47.46.E02.1.454.heavy.3.raw

SEQ ID NO: 445185 - DNA, 409 bp, Homo sapiens; identical to SEQ ID NO: 444519
  misc_feature: HEFZJCU01AGMJ5.3.41.D08.1.454.heavy.3.raw

SEQ ID NO: 445186 - DNA, 386 bp, Homo sapiens
  misc_feature: HEFZJCU01A7BS5.9.63.F08.1.454.heavy.3.raw
tgatacgtctcacgaccggtgctcgatttagcgatcgtataagggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacagcggccctgggctgcctggtcaaggactacttccagacgtatca

SEQ ID NO: 445187 - DNA, 483 bp, Homo sapiens; identical to SEQ ID NO: 444924
  misc_feature: HEFZJCU01D7ZGR.10.35.D02.1.454.heavy.3.raw

SEQ ID NO: 445188 - DNA, 400 bp, Homo sapiens; identical to SEQ ID NO: 444452
  misc_feature: HEFZJCU01ELP9G.47.24.C02.1.454.heavy.3.raw

SEQ ID NO: 445189 - DNA, 427 bp, Homo sapiens; identical to SEQ ID NO: 444708
  misc_feature: HEFZJCU01DHQT0.9.34.D01.1.454.heavy.3.raw

SEQ ID NO: 445190 - DNA, 396 bp, Homo sapiens; identical to SEQ ID NO: 444426
  misc_feature: HEFZJCU01AL0YK.18.31.C09.1.454.heavy.3.raw

SEQ ID NO: 445191 - DNA, 488 bp, Homo sapiens
  misc_feature: HEFZJCU01A8I5H.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgtagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgaacttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtagct

SEQ ID NO: 445192 - DNA, 510 bp, Homo sapiens
  misc_feature: HEFZJCU01CUN5A.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctgcgccctgctccaggagcacctctgggggcacagcggccctgggctgcctggtcaaggactacttcccata

SEQ ID NO: 445193 - DNA, 521 bp, Homo sapiens
  misc_feature: HEFZJCU01A26O2.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaaggggacccg

SEQ ID NO: 445194 - DNA, 491 bp, Homo sapiens
  misc_feature: HEFZJCU01C518G.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctgggggcacagcggccctgggctgcctggtcaaggactacttccgtatctcgct

SEQ ID NO: 445195 - DNA, 327 bp, Homo sapiens
  misc_feature: HEFZJCU01C2WYF.40.20.B09.1.454.heavy.3.raw
tctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctcgtggggcacagcggccctgggctgcctggtcaaggactacttccagtcgctaga

SEQ ID NO: 445196 - DNA, 392 bp, Homo sapiens; identical to SEQ ID NO: 444682
  misc_feature: HEFZJCU01BIHZW.16.70.G04.1.454.heavy.3.raw

SEQ ID NO: 445197 - DNA, 537 bp, Homo sapiens
  misc_feature: HEFZJCU01BW11K.52.57.F02.1.454.heavy.3.raw
  modified_base (536)..(536): a, c, t, g, unknown or other
cgcagtacgacacgaccggtgctcgatttagctcgatatagttggggtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagttttggagtggccaaagacggcaggttccgctacgggttggacgtctggggccaagggaccacggtcaccgtcgcctcagcctccaccaagggcccatcggtctcccctggcacctcctccaagng

SEQ ID NO: 445198 - DNA, 400 bp, Homo sapiens; identical to SEQ ID NO: 444452
  misc_feature: HEFZJCU01A6WBF.47.24.C02.1.454.heavy.3.raw

SEQ ID NO: 445199 - DNA, 410 bp, Homo sapiens
  misc_feature: HEFZJCU01CVF6A.9.11.A11.1.454.heavy.3.raw
tgatacgtctcacgaccggtgctcgatttagctacgactgcagggaagggcctggagtacattggggacatctatgccactgggagcaccgactacaacccgtccctcgagagtcgactctccatgtcccttgacacgtctaagaaccagtattccctgcaactgagctccgtgactgccgctgacacggccgtttattactgtgccataacagcctgtattactaccagttgctatcatctgagtccggacagctactttgtctcctggggcctgggaaccctggtcaccgtctcctcagcctccaccaagggcccatcggtcttccccctggcaccctcctccaagagcacctctgggggcacagcggccctgggctgcctggtcaaggactacttccagacgtatca

SEQ ID NO: 445200 - DNA, 470 bp, Homo sapiens; identical to SEQ ID NO: 444866
  misc_feature: HEFZJCU01D17KR.4.36.D03.1.454.heavy.3.raw

SEQ ID NO: 445201 - DNA, 382 bp, Homo sapiens
  misc_feature: HEFZJCU01DT46P.13.77.G11.1.454.heavy.3.raw
tcacgtactacacgaccggtgctcgatttagctagtcactcaagggaaagggactggagtgggtgtcggcgatcaaaggtgatggttctaataaatattatgcagactccgtgaagggccggttcaccatctccagagacaattccaagaacacactttatctccaaatgaacagcctgagaagcgacgacacggccctatattattgtacaaaagagtccggaggtagtgacaactactggggccagggaaccctggtcaccgtctccgcagcctccaccaagggcccatcggtcttccccctggcaccctcctccaagagcacctctgggggcacagcggccctgggctgcctggtcaaggactacttcctagtacgtga

SEQ ID NO: 445202 - DNA, 396 bp, Homo sapiens; identical to SEQ ID NO: 444469
  misc_feature: HEFZJCU01COI36.47.46.E02.1.454.heavy.3.raw

SEQ ID NO: 445203 - DNA, 383 bp, Homo sapiens
  misc_feature: HEFZJCU01BF9HO.21.46.E02.1.454.heavy.3.raw
tcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacga

SEQ ID NO: 445204 - DNA, 325 bp, Homo sapiens
  misc_feature: HEFZJCU01AHU9Q.18.17.B06.1.454.heavy.3.raw
tacgagtatgcacgaccggtgctcgatttagtcgatagtgaagggccgattcaccatctccagagacaattccaagaacacggtgtcaatggaaatagaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 445205 - DNA, 384 bp, Homo sapiens; identical to SEQ ID NO: 444556
  misc_feature: HEFZJCU01C61JC.22.46.E02.1.454.heavy.3.raw

SEQ ID NO: 445206 - DNA, 536 bp, Homo sapiens
  misc_feature: HEFZJCU01BJ4DK.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgacgaggcacagccggccctcggggccgtcgccgtggtacgaacggacttaccttccttacc

SEQ ID NO: 445207 - DNA, 379 bp, Homo sapiens; identical to SEQ ID NO: 444450
  misc_feature: HEFZJCU01A90O8.47.77.G11.1.454.heavy.3.raw

SEQ ID NO: 445208 - DNA, 509 bp, Homo sapiens; identical to SEQ ID NO: 444586
  misc_feature: HEFZJCU01ENMUB.12.78.H01.1.454.heavy.3.raw

SEQ ID NO: 445209 - DNA, 422 bp, Homo sapiens
  misc_feature: HEFZJCU01ECESE.3.25.C03.1.454.heavy.3.raw
agacgcactccacgaccggtgctcgatttagtagtgtagatttgggtttggggatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccgagtgcgtct

SEQ ID NO: 445210 - DNA, 403 bp, Homo sapiens; identical to SEQ ID NO: 444495
  misc_feature: HEFZJCU01BN9Y1.53.77.G11.1.454.heavy.3.raw

SEQ ID NO: 445211 - DNA, 390 bp, Homo sapiens
  misc_feature: HEFZJCU01CHLD0.13.42.D09.1.454.heavy.3.raw
tcacgtactacacgaccggtgctcgatttagacacatacgcagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgtgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtga

SEQ ID NO: 445212 - DNA, 515 bp, Homo sapiens
  misc_feature: HEFZJCU01AOJEA.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgactactggggccagggatccctggtcaccgtctcctcagcctccaccaagggcccatcggtcttcccctc

SEQ ID NO: 445213 - DNA, 445 bp, Homo sapiens
  misc_feature: HEFZJCU01AX1VJ.3.86.H09.1.454.heavy.3.raw
agacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctgggggcacagcggccctgggctgcctggtcaaggactacttccgagtgcgtct

SEQ ID NO: 445214 - DNA, 309 bp, Homo sapiens; identical to SEQ ID NO: 444418
  misc_feature: HEFZJCU01ERU6X.18.53.E09.1.454.heavy.3.raw

SEQ ID NO: 445215 - DNA, 484 bp, Homo sapiens
  misc_feature: HEFZJCU01DGZV1.12.40.D07.1.454.heavy.3.raw
atacgacgtacacgaccggtgctcgatttagtgatagagcgtaacaacagaggactcaccatggagtttgggctgagcgtggtttcgtcgtaggcgtctttaagtaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctcccagcctccaccaagggcccatcggtcttcccctggcgccctgctccaggagcacctccgagagcacagcggccctgggctgcctggtcaaggctacttcctacgtcgtat

SEQ ID NO: 445216 - DNA, 400 bp, Homo sapiens; identical to SEQ ID NO: 444452
  misc_feature: HEFZJCU01CKIYE.47.24.C02.1.454.heavy.3.raw

SEQ ID NO: 445217 - DNA, 491 bp, Homo sapiens; identical to SEQ ID NO: 444592
  misc_feature: HEFZJCU01BSRNZ.11.26.C04.1.454.heavy.3.raw

SEQ ID NO: 445218 - DNA, 459 bp, Homo sapiens
  misc_feature: HEFZJCU01EMTQP.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 445219 - DNA, 487 bp, Homo sapiens
  misc_feature: HEFZJCU01EI2LV.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttcccactactatg

SEQ ID NO: 445220 - DNA, 518 bp, Homo sapiens
  misc_feature: HEFZJCU01EEIJ1.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaa

SEQ ID NO: 445221 - DNA, 479 bp, Homo sapiens
  misc_feature: HEFZJCU01CYO19.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggcctggctgcctggtcaaggactacttcgtatctctcg

SEQ ID NO: 445222 - DNA, 504 bp, Homo sapiens
  misc_feature: HEFZJCU01EARAD.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 445223 - DNA, 496 bp, Homo sapiens; identical to SEQ ID NO: 444697
  misc_feature: HEFZJCU01BCUNJ.16.37.D04.1.454.heavy.3.raw

SEQ ID NO: 445224 - DNA, 370 bp, Homo sapiens
  misc_feature: HEFZJCU01EYOU8.3.42.D09.1.454.heavy.3.raw
agacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactgggccaggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 445225 - DNA, 509 bp, Homo sapiens
  misc_feature: HEFZJCU01B3MAH.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 445226 - DNA, 482 bp, Homo sapiens; identical to SEQ ID NO: 444904
  misc_feature: HEFZJCU01BVGSY.47.59.F04.1.454.heavy.3.raw

SEQ ID NO: 445227 - DNA, 395 bp, Homo sapiens
  misc_feature: HEFZJCU01EAFWC.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 445228 - DNA, 532 bp, Homo sapiens
  misc_feature: HEFZJCU01BP00R.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggg

SEQ ID NO: 445229 - DNA, 387 bp, Homo sapiens
  misc_feature: HEFZJCU01DB1N3.11.20.B09.1.454.heavy.3.raw
cgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccctgggctgcctggtcaaggactacttccgtatctctcg

SEQ ID NO: 445230 - DNA, 508 bp, Homo sapiens
  misc_feature: HEFZJCU01CGYZ7.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttcccctggcaccctcctccaagagcacctctgggggcacagcggccctgggctgcctggtcaaggactacttccgtact

SEQ ID NO: 445231 - DNA, 489 bp, Homo sapiens; identical to SEQ ID NO: 444791
  misc_feature: HEFZJCU01BI9AX.47.85.H08.1.454.heavy.3.raw

SEQ ID NO: 445232 - DNA, 379 bp, Homo sapiens; identical to SEQ ID NO: 444450
  misc_feature: HEFZJCU01CLC6V.47.77.G11.1.454.heavy.3.raw

SEQ ID NO: 445233 - DNA, 315 bp, Homo sapiens
  misc_feature: HEFZJCU01D490C.7.10.A10.1.454.heavy.3.raw
cgtgtctctacacgaccggtgctcgatttagcgtcgatctccagggacaacgccaagaagtcactgtatctacaaatgaacagcctgagagccgaggacgacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacg

SEQ ID NO: 445234 - DNA, 372 bp, Homo sapiens; identical to SEQ ID NO: 444727
  misc_feature: HEFZJCU01EE7MM.3.42.D09.1.454.heavy.3.raw

SEQ ID NO: 445235 - DNA, 387 bp, Homo sapiens
  misc_feature: HEFZJCU01B383J.9.63.F08.1.454.heavy.3.raw
tgatacgtctcacgaccggtgctcgatttagcgatcgtataagggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgattttttggatgtctggggccaaggtacagcggtcaccgtcgcctcagcctccaccaagggcccatcggtcttccccctggcaccctcctccaagagcacctctgggggcacagcggccctgggctgcctggtcaaggactacttccagacgtatca

SEQ ID NO: 445236 - DNA, 389 bp, Homo sapiens
  misc_feature: HEFZJCU01EMDP3.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactattccgagtagtaca

SEQ ID NO: 445237 - DNA, 398 bp, Homo sapiens
  misc_feature: HEFZJCU01A6PPA.4.79.H02.1.454.heavy.3.raw
agcactgtagcacgaccggtgctcgatttagtgtcacacgaagggaaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttccccctggcgccctgctccaggagcacctccgagagcacagcggccctgggctgcctggtcaaggactactccctacagtgct

SEQ ID NO: 445238 - DNA, 510 bp, Homo sapiens
  misc_feature: HEFZJCU01D2JN4.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaggactactcccatac

SEQ ID NO: 445239 - DNA, 523 bp, Homo sapiens
  misc_feature: HEFZJCU01DVF7V.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactactcc

SEQ ID NO: 445240 - DNA, 380 bp, Homo sapiens
  misc_feature: HEFZJCU01E2W7D.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctcctgggggcgacagcggccctgggctgcctggtcaaggactacttcctacgtgagct

SEQ ID NO: 445241 - DNA, 463 bp, Homo sapiens
  misc_feature: HEFZJCU01D8A6E.13.11.A11.1.454.heavy.3.raw
tcacgtactacacgaccggtgctcgatttagctacgactgcagggcttctggaggcaccttcagcacctatgctatcagctgggtgcgacaggcccctggacaagggcttgagtggatgggagggatcatcccgatctttgggaaaccaaactacgcacagaaattccagggcagaatcacgattaccgcggacgaatccacgaccacagcctacatggagctgagcagcctgagatctgaggacacggccgtgtattactgtgcgagagggtcgggccgatattttgactggttatccccctctgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttcctagtacgtga

SEQ ID NO: 445242 - DNA, 387 bp, Homo sapiens; identical to SEQ ID NO: 445229
  misc_feature: HEFZJCU01DY789.11.20.B09.1.454.heavy.3.raw

SEQ ID NO: 445243 - DNA, 506 bp, Homo sapiens
  misc_feature: HEFZJCU01D6IHK.48.27.C05.1.454.heavy.3.raw
agtatacatacacgaccggtgctcgatttagacgcgatcgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 445244 - DNA, 470 bp, Homo sapiens; identical to SEQ ID NO: 444866
  misc_feature: HEFZJCU01DT1GA.4.36.D03.1.454.heavy.3.raw

SEQ ID NO: 445245 - DNA, 395 bp, Homo sapiens; identical to SEQ ID NO: 444517
  misc_feature: HEFZJCU01EAXHA.16.68.G02.1.454.heavy.3.raw

SEQ ID NO: 445246 - DNA, 409 bp, Homo sapiens
  misc_feature: HEFZJCU01DO2BP.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcatcgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 445247 - DNA, 505 bp, Homo sapiens
  misc_feature: HEFZJCU01CGMTJ.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaaggcccatcggtcttcccctggcaccctcctccaagagcacctctgggggcacagcggccctgggctgcctggtcaaggactacttcctagtacgtga

SEQ ID NO: 445248 - DNA, 414 bp, Homo sapiens
  misc_feature: HEFZJCU01CIC8S.14.74.G08.1.454.heavy.3.raw
cgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctggggcacagcggccctgggctgcctggtcaaggactacttccgtactagacg

SEQ ID NO: 445249 - DNA, 513 bp, Homo sapiens
  misc_feature: HEFZJCU01CNXDI.8.37.D04.1.454.heavy.3.raw
ctcgcgtgtccacgaccggtgctcgatttagtagcatactgttgggtttgggtgcccaagctgctggagggcacggtcaccacgctgctgagatgaagagtccgtggggcctcagtgaagatttcctgcaaggcgtccggatacaggttcaccgccgtctatattaattggctgcgacacggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagctttgaattttggggccaagggacaatggtcatcgtctcctcagcctccaccaacgggccatcggtcttcccctggcaccctcctccaagagcacctcgtgggggcacagcggccctgggctgtccg

SEQ ID NO: 445250 - DNA, 379 bp, Homo sapiens; identical to SEQ ID NO: 444450
  misc_feature: HEFZJCU01EA8II.47.77.G11.1.454.heavy.3.raw

SEQ ID NO: 445251 - DNA, 410 bp, Homo sapiens
  misc_feature: HEFZJCU01DZOUX.19.25.C03.1.454.heavy.3.raw
tactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 445252 - DNA, 477 bp, Homo sapiens; identical to SEQ ID NO: 444659
  misc_feature: HEFZJCU01DOFQL.16.10.A10.1.454.heavy.3.raw

SEQ ID NO: 445253 - DNA, 338 bp, Homo sapiens; identical to SEQ ID NO: 444423
  misc_feature: HEFZJCU01DKGX0.47.38.D05.1.454.heavy.3.raw

SEQ ID NO: 445254 - DNA, 315 bp, Homo sapiens; identical to SEQ ID NO: 444422
  misc_feature: HEFZJCU01CJ59K.47.84.H07.1.454.heavy.3.raw

SEQ ID NO: 445255 - DNA, 382 bp, Homo sapiens
  misc_feature: HEFZJCU01C6JJ8.48.45.E01.1.454.heavy.3.raw
agtatacatacacgaccggtgctcgatttagtgagtcagtaagggaaagggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgttttatccctggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 445256 - DNA, 372 bp, Homo sapiens; identical to SEQ ID NO: 444727
  misc_feature: HEFZJCU01DKKCF.3.42.D09.1.454.heavy.3.raw

SEQ ID NO: 445257 - DNA, 324 bp, Homo sapiens; identical to SEQ ID NO: 444475
  misc_feature: HEFZJCU01DHSFQ.18.17.B06.1.454.heavy.3.raw

SEQ ID NO: 445258 - DNA, 308 bp, Homo sapiens; identical to SEQ ID NO: 445047
  misc_feature: HEFZJCU01B5C4T.7.14.B03.1.454.heavy.3.raw

SEQ ID NO: 445259 - DNA, 524 bp, Homo sapiens
  misc_feature: HEFZJCU01COLCU.49.33.C11.1.454.heavy.3.raw
agtcgagagacacgaccggtgctcgatttagagtgagctcgttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatccccgggtatagcagtgtctggtacatattactggggccagggaaccctggtcaccgtctcctcagcctccaccaagggcccatcggtcttcccctggcgccctgctccaggagcacctccgagagcacagcc

SEQ ID NO: 445260 - DNA, 523 bp, Homo sapiens
  misc_feature: HEFZJCU01D5MQO.13.63.F08.1.454.heavy.3.raw
tcacgtactacacgaccggtgctcgatttagcgatcgtataaggggacccaaaaaccacacccctccttgggagaatcccgtagatcacagctcctcaccatcggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccaggggacaagtggtcaccgtctcttcagt

SEQ ID NO: 445261 - DNA, 491 bp, Homo sapiens
  misc_feature: HEFZJCU01CJ1VP.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagtggccctgggctgcctggtcaaggactacttcccacgagagta

SEQ ID NO: 445262 - DNA, 422 bp, Homo sapiens; identical to SEQ ID NO: 444681
  misc_feature: HEFZJCU01D7TX3.16.78.H01.1.454.heavy.3.raw

SEQ ID NO: 445263 - DNA, 524 bp, Homo sapiens
  misc_feature: HEFZJCU01CJUTF.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttactaccttgacacttggggccagggaaccctggtcaccgtctcctcagcctccaccaagggcccatcggtcttcccctggcgccctgctccaggagcacctccgagagcacagcggccctgggctgcctggtcaaggactacttcc

SEQ ID NO: 445264 - DNA, 330 bp, Homo sapiens
  misc_feature: HEFZJCU01B8C01.53.44.D11.1.454.heavy.3.raw
cgcgtatacacacgaccggtgctcgatttagcgcagtacgaagggccggttcatcatgtccagagacaactccaagaacacactgtatctgcaaatgaacagcctaagagccgaggacacggccgtatattactgtgcgaagatttgggggtggcaactggagtggtttttagatccgattgactcctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 445265 - DNA, 313 bp, Homo sapiens; identical to SEQ ID NO: 444518
  misc_feature: HEFZJCU01EZIFF.7.10.A10.1.454.heavy.3.raw

SEQ ID NO: 445266 - DNA, 495 bp, Homo sapiens; identical to SEQ ID NO: 444618
  misc_feature: HEFZJCU01DZA6U.3.26.C04.1.454.heavy.3.raw

SEQ ID NO: 445267 - DNA, 383 bp, Homo sapiens; identical to SEQ ID NO: 444673
  misc_feature: HEFZJCU01EYV95.11.61.F06.1.454.heavy.3.raw

SEQ ID NO: 445268 - DNA, 511 bp, Homo sapiens
  misc_feature: HEFZJCU01EEIP8.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactt

SEQ ID NO: 445269 - DNA, 505 bp, Homo sapiens
  misc_feature: HEFZJCU01DR0A0.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagctttgaattttggggccaagggacaatggtcatcgtctcctcagcctccaccaagggcccatcggtcttcccctggcaccctcctccaagagcacctctgggggcacagcggccctggctg

SEQ ID NO: 445270 - DNA, 465 bp, Homo sapiens
  misc_feature: HEFZJCU01BR94M.48.14.B03.1.454.heavy.3.raw
agtatacatacacgaccggtgctcgatttagtgtgagtagttccgcgggcacgaccggtgctcgatttagtgtgagtagttccgcggcacgaccggtgctcgatttagtgtagtgtgaagggaaaggggctggagtgggttggccgtgttaaaaccaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 445271 - DNA, 391 bp, Homo sapiens
  misc_feature: HEFZJCU01EQ9V5.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctcggcgccctgctccaggagcacctccgagagcacagcggccctgggctgcctggtcaaggactacttccgagtagtaca

SEQ ID NO: 445272 - DNA, 376 bp, Homo sapiens
  misc_feature: HEFZJCU01CAG39.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtggtatattactgtgcgagccccggcgcttttgggcggaattcgggactgtggggccagggaaccctggtcagcgtctcagcctccaccaagggcccatcggtcttccccctggcgccctgctccaggagcaccgtccgagagcacagcggccctgggctgcctggtcaaggactacttcctagagacacg

SEQ ID NO: 445273 - DNA, 335 bp, Homo sapiens
  misc_feature: HEFZJCU01CUIRZ.51.9.A09.1.454.heavy.3.raw
cgatcgtatacacgaccggtgctcgatttagcgagacgcgcagggccgattcaccatctccagagacgacgccaagaattcactgtatctgaaaatgaacagcctgagagccgacgacacggctgtttattactgtgcgagagattactatcatagtagtggttttttccctactactccggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 445274 - DNA, 391 bp, Homo sapiens; identical to SEQ ID NO: 444896
  misc_feature: HEFZJCU01C7T2U.48.62.F07.1.454.heavy.3.raw

SEQ ID NO: 445275 - DNA, 469 bp, Homo sapiens
  misc_feature: HEFZJCU01CRRIX.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactactccctacaatgct

SEQ ID NO: 445276 - DNA, 490 bp, Homo sapiens; identical to SEQ ID NO: 444500
  misc_feature: HEFZJCU01CT111.19.53.E09.1.454.heavy.3.raw

SEQ ID NO: 445277 - DNA, 536 bp, Homo sapiens
  misc_feature: HEFZJCU01D3YEQ.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactccctgtacagcctctggattcactttcagtaaggcctggatgaactgggtccgccaggctccagggaagggctggagtgggttggccgtattaaaccaaactgatggtgggacaacagactacgctgcacccgtgaaaggcagattcaccatctcaagagatgattacaaaagcacgctgtatctgcaatgaacagcctgagaaccgaggacacagccgtgtattactgtaccacactccctagaaacgcgtacaactactactactacggtatcggacctcgtgggaccg

SEQ ID NO: 445278 - DNA, 419 bp, Homo sapiens
  misc_feature: HEFZJCU01CFEWD.4.22.B11.1.454.heavy.3.raw
agcactgtagcacgaccggtgctcgatttagacgacagctccagggaaggggctggagtggattggtttcattagaagcaaaacttatggtgggacaccagaatatgccgcgtctgtgaaaggcagattcaccatctcaagagatgattccaaaagtgtcgcctacctccagatgactagcctgaagaccgaagactcagccctttattactgtgctagagatcgactggcccgttacgatttttggcgtggcccgacggaacatcctcagactcctggggtcagggaaccctggtcaccgtctcctcagcctccaccaagggcccatcggtcttccccctggcaccctcctccaagagcacctctgggggcacagcggccctgggctgcctggtcaaggactacttccctacagtgct

SEQ ID NO: 445279 - DNA, 512 bp, Homo sapiens
  misc_feature: HEFZJCU01EUP8V.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaagggccc

SEQ ID NO: 445280 - DNA, 390 bp, Homo sapiens; identical to SEQ ID NO: 444541
  misc_feature: HEFZJCU01EU2VN.16.24.C02.1.454.heavy.3.raw

SEQ ID NO: 445281 - DNA, 521 bp, Homo sapiens
  misc_feature: HEFZJCU01EG7HL.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccgggaaccctggtcaccgtctcccaccctccaccaagggcccatcggtcttcccctggcaccctcctccaagagcacctctgggggcacagcggccctgggctgcctggtcaaggactacttccatactcgta

SEQ ID NO: 445282 - DNA, 396 bp, Homo sapiens; identical to SEQ ID NO: 444469
  misc_feature: HEFZJCU01CU4ML.47.46.E02.1.454.heavy.3.raw

SEQ ID NO: 445283 - DNA, 395 bp, Homo sapiens; identical to SEQ ID NO: 444517
  misc_feature: HEFZJCU01D4XAD.16.68.G02.1.454.heavy.3.raw

SEQ ID NO: 445284 - DNA, 464 bp, Homo sapiens; identical to SEQ ID NO: 445062
  misc_feature: HEFZJCU01AG1U5.19.10.A10.1.454.heavy.3.raw

SEQ ID NO: 445285 - DNA, 470 bp, Homo sapiens; identical to SEQ ID NO: 444866
  misc_feature: HEFZJCU01EHL8E.4.36.D03.1.454.heavy.3.raw

SEQ ID NO: 445286 - DNA, 410 bp, Homo sapiens
  misc_feature: HEFZJCU01CY6TO.52.33.C11.1.454.heavy.3.raw
cgcagtacgacacgaccggtgctcgatttagagtgagctcgttgggtttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 445287 - DNA, 324 bp, Homo sapiens; identical to SEQ ID NO: 444475
  misc_feature: HEFZJCU01DVXOT.18.17.B06.1.454.heavy.3.raw

SEQ ID NO: 445288 - DNA, 508 bp, Homo sapiens
  misc_feature: HEFZJCU01DV2C8.51.43.D10.1.454.heavy.3.raw
cgatcgtatacacgaccggtgctcgatttagactagcagtaagggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaaactaccttcattactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 445289 - DNA, 396 bp, Homo sapiens; identical to SEQ ID NO: 444469
  misc_feature: HEFZJCU01EA3FR.47.46.E02.1.454.heavy.3.raw

SEQ ID NO: 445290 - DNA, 390 bp, Homo sapiens; identical to SEQ ID NO: 444541
  misc_feature: HEFZJCU01AG43E.16.24.C02.1.454.heavy.3.raw

SEQ ID NO: 445291 - DNA, 396 bp, Homo sapiens
  misc_feature: HEFZJCU01C0Q6T.51.70.G04.1.454.heavy.3.raw
cgatcgtatacacgaccggtgctcgatttagtgtagtgtgaagggaaaggggctggagtggatcgaagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 445292 - DNA, 402 bp, Homo sapiens
  misc_feature: HEFZJCU01AGWQV.13.79.H02.1.454.heavy.3.raw
tcacgtactacacgaccggtgctcgatttagtgtcacacgaagggaaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattggggcggaaggtatagcagtggcacgtactactttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 445293 - DNA, 390 bp, Homo sapiens; identical to SEQ ID NO: 444541
  misc_feature: HEFZJCU01EMHX3.16.24.C02.1.454.heavy.3.raw

SEQ ID NO: 445294 - DNA, 521 bp, Homo sapiens
  misc_feature: HEFZJCU01A8J6S.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactgggggccagggaagcttggtcaccgtctcctcagcct

SEQ ID NO: 445295 - DNA, 387 bp, Homo sapiens; identical to SEQ ID NO: 444635
  misc_feature: HEFZJCU01EL08F.11.27.C05.1.454.heavy.3.raw

SEQ ID NO: 445296 - DNA, 509 bp, Homo sapiens
  misc_feature: HEFZJCU01C4H3V.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactgggccagggcaccctggtcaccgtctcctcagcttccaccaagggcccatcggtcttccccctggcgccctgctccaggagcacctctgggggcacagcggccctgggctgcctggtcaaggactactcccata

SEQ ID NO: 445297 - DNA, 432 bp, Homo sapiens; identical to SEQ ID NO: 444920
  misc_feature: HEFZJCU01CAAOJ.11.39.D06.1.454.heavy.3.raw

SEQ ID NO: 445298 - DNA, 516 bp, Homo sapiens
  misc_feature: HEFZJCU01EL10M.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactactcct

SEQ ID NO: 445299 - DNA, 482 bp, Homo sapiens; identical to SEQ ID NO: 444503
  misc_feature: HEFZJCU01D5JJB.7.10.A10.1.454.heavy.3.raw

SEQ ID NO: 445300 - DNA, 400 bp, Homo sapiens
  misc_feature: HEFZJCU01EF9C2.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgtggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 445301 - DNA, 400 bp, Homo sapiens
  misc_feature: HEFZJCU01D9ARI.11.70.G04.1.454.heavy.3.raw
cgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttcccctggcaccctcctccaagagcacctctggggcacagcggccctgggctgcctggtcaaggactacttccgtatctctcg

SEQ ID NO: 445302 - DNA, 405 bp, Homo sapiens
  misc_feature: HEFZJCU01DTK40.3.17.B06.1.454.heavy.3.raw
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 445303 - DNA, 489 bp, Homo sapiens; identical to SEQ ID NO: 444791
  misc_feature: HEFZJCU01EMEAX.47.85.H08.1.454.heavy.3.raw

SEQ ID NO: 445304 - DNA, 380 bp, Homo sapiens
  misc_feature: HEFZJCU01EJJB0.3.26.C04.1.454.heavy.3.raw
agacgcactccacgaccggtgctcgatttagtctagcgactttgggtttgggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttccccctggcgccctgctccaggagcacctccgagagcacagcggccctgggctgcctggtcaaggactacttccgagtgcgtct

SEQ ID NO: 445305 - DNA, 316 bp, Homo sapiens
  misc_feature: HEFZJCU01EQFHT.13.17.B06.1.454.heavy.3.raw
tcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagattggggcacgacattttgtagaggtgtactggggccagggagcccggtcaccgtctcctcaggcctccaccaagggcccatcggtcttccccctggcgccctgctccaggagcacctccgagagcacagcggccctgggctgcctggtcaaggactacttcctagtacgtga

SEQ ID NO: 445306 - DNA, 512 bp, Homo sapiens
  misc_feature: HEFZJCU01DNDPQ.52.34.D01.1.454.heavy.3.raw
cgcagtacgacacgaccggtgctcgatttagatcgtctgtgcaactgttggagtctgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 445307 - DNA, 470 bp, Homo sapiens
  misc_feature: HEFZJCU01CGMCY.12.78.H01.1.454.heavy.3.raw
atacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 445308 - DNA, 513 bp, Homo sapiens
  misc_feature: HEFZJCU01DZ692.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggcccc

SEQ ID NO: 445309 - DNA, 384 bp, Homo sapiens; identical to SEQ ID NO: 444556
  misc_feature: HEFZJCU01CY8HU.22.46.E02.1.454.heavy.3.raw

SEQ ID NO: 445310 - DNA, 477 bp, Homo sapiens
  misc_feature: HEFZJCU01ET7EJ.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctggcgaccctgctccaggagcacctccgagagcacagcggccctcgggctgcctggtcaaggactacttccgagtgcgtct

SEQ ID NO: 445311 - DNA, 484 bp, Homo sapiens
  misc_feature: HEFZJCU01BCG4J.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 445312 - DNA, 429 bp, Homo sapiens
  misc_feature: HEFZJCU01C03BB.40.53.E09.1.454.heavy.3.raw
tctagcgactcacgaccggtgctcgatttagagagagtgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggcctgggctgcctggtcaaggactacttccagtcgctaga

SEQ ID NO: 445313 - DNA, 402 bp, Homo sapiens; identical to SEQ ID NO: 444815
  misc_feature: HEFZJCU01EPIET.11.70.G04.1.454.heavy.3.raw

SEQ ID NO: 445314 - DNA, 396 bp, Homo sapiens; identical to SEQ ID NO: 444469
  misc_feature: HEFZJCU01B5DA5.47.46.E02.1.454.heavy.3.raw

SEQ ID NO: 445315 - DNA, 470 bp, Homo sapiens; identical to SEQ ID NO: 444866
  misc_feature: HEFZJCU01DRQVZ.4.36.D03.1.454.heavy.3.raw

SEQ ID NO: 445316 - DNA, 360 bp, Homo sapiens
  misc_feature: HEFZJCU01E0N2G.16.17.B06.1.454.heavy.3.raw
tgtactactccacgaccggtgctcgatttagtcgatagtgaagggggggttccaactacaatccgtccctcaagagtcgactcaccctttcggtggacaagtccaagaaccacttctccctgcggttatgttctgtgaccgccgcggacacggccgtgtattactgtgcaaaacttacgacttttggagtggacctgttccggacatgttcgacccctggggccaaggaaccctggtcaccgtctctccagcttccaccaagggcccatccgtcttccccctggcgccctgctccaggagcacctccgagagcacagccgccctgggctgcctggtcaaggactacttccgagtagtaca

SEQ ID NO: 445317 - DNA, 521 bp, Homo sapiens
  misc_feature: HEFZJCU01BZBLW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 445318 - DNA, 396 bp, Homo sapiens; identical to SEQ ID NO: 444469
  misc_feature: HEFZJCU01EHDNG.47.46.E02.1.454.heavy.3.raw

SEQ ID NO: 445319 - DNA, 482 bp, Homo sapiens; identical to SEQ ID NO: 444744
  misc_feature: HEFZJCU01DA2ZI.11.23.C01.1.454.heavy.3.raw

SEQ ID NO: 445320 - DNA, 312 bp, Homo sapiens
  misc_feature: HEFZJCU01DQSI3.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggcctgggctgcctggtcaaggactacttcctagagacacg

SEQ ID NO: 445321 - DNA, 521 bp, Homo sapiens; identical to SEQ ID NO: 445317
  misc_feature: HEFZJCU01D7TAH.12.40.D07.1.454.heavy.3.raw

SEQ ID NO: 445322 - DNA, 520 bp, Homo sapiens
  misc_feature: HEFZJCU01EEUX3.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccac

SEQ ID NO: 445323 - DNA, 483 bp, Homo sapiens; identical to SEQ ID NO: 444924
  misc_feature: HEFZJCU01CGVDZ.10.35.D02.1.454.heavy.3.raw

SEQ ID NO: 445324 - DNA, 483 bp, Homo sapiens; identical to SEQ ID NO: 444924
  misc_feature: HEFZJCU01DDTMM.10.35.D02.1.454.heavy.3.raw

SEQ ID NO: 445325 - DNA, 483 bp, Homo sapiens; identical to SEQ ID NO: 444924
  misc_feature: HEFZJCU01D1HKM.10.35.D02.1.454.heavy.3.raw

SEQ ID NO: 445326 - DNA, 388 bp, Homo sapiens
  misc_feature: HEFZJCU01BTEHM.49.26.C04.1.454.heavy.3.raw
agtcgagagacacgaccggtgctcgatttagtctagcgactttgggtttgggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 445327 - DNA, 501 bp, Homo sapiens; identical to SEQ ID NO: 445027
  misc_feature: HEFZJCU01AYIPS.26.23.C01.1.454.heavy.3.raw

SEQ ID NO: 445328 - DNA, 427 bp, Homo sapiens; identical to SEQ ID NO: 444708
  misc_feature: HEFZJCU01BEE3Z.9.34.D01.1.454.heavy.3.raw

SEQ ID NO: 445329 - DNA, 385 bp, Homo sapiens
  misc_feature: HEFZJCU01CSNFP.22.46.E02.1.454.heavy.3.raw
acatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaagggactacttccagacgtatca

SEQ ID NO: 445330 - DNA, 519 bp, Homo sapiens
  misc_feature: HEFZJCU01EY772.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 445331 - DNA, 313 bp, Homo sapiens; identical to SEQ ID NO: 444518
  misc_feature: HEFZJCU01DLP0N.7.10.A10.1.454.heavy.3.raw

SEQ ID NO: 445332 - DNA, 531 bp, Homo sapiens
  misc_feature: HEFZJCU01EVJUN.9.33.C11.1.454.heavy.3.raw
tgatacgtctcacgaccggtgctcgatttagagtgagctcgttgggtttgggctgagcgtgggttttccgtcgttaggctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaagaggggggatacagtggcagctccaagtactactttgacttctggggccagggaaccctggtcaccgtctcctcagcctccaccaagggcccatcggtcttcccctggcgccctgctccaggagcacctccgagacg

SEQ ID NO: 445333 - DNA, 491 bp, Homo sapiens
  misc_feature: HEFZJCU01EVMI4.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 445334 - DNA, 509 bp, Homo sapiens
  misc_feature: HEFZJCU01CNGFQ.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctggtttctgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggacttctggggccagggaacccg

SEQ ID NO: 445335 - DNA, 400 bp, Homo sapiens; identical to SEQ ID NO: 444452
  misc_feature: HEFZJCU01ANPZS.47.24.C02.1.454.heavy.3.raw

SEQ ID NO: 445336 - DNA, 404 bp, Homo sapiens
  misc_feature: HEFZJCU01E2K7G.3.72.G06.1.454.heavy.3.raw
agacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaagggcccatcggtcttccccctggcaccctcctccaagagcacctctgggggcgacagcggccctgggctgcctggtcaaggactacttccgagtgcgtct

SEQ ID NO: 445337 - DNA, 374 bp, Homo sapiens
  misc_feature: HEFZJCU01DIX1B.11.26.C04.1.454.heavy.3.raw
cgagagataccacgaccggtgctcgatttagtctagcgactttgggtttgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 445338 - DNA, 390 bp, Homo sapiens; identical to SEQ ID NO: 444541
  misc_feature: HEFZJCU01C3D0T.16.24.C02.1.454.heavy.3.raw

SEQ ID NO: 445339 - DNA, 519 bp, Homo sapiens
  misc_feature: HEFZJCU01BY2RQ.9.34.D01.1.454.heavy.3.raw
tgatacgtctcacgaccggtgctcgatttagatcgtctgtgttgggtttggaggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggccaccctcctccaagagcacctctgggggcacagcggccctgggctgcctggtcaaggactacttccagacgtatca

SEQ ID NO: 445340 - DNA, 509 bp, Homo sapiens
  misc_feature: HEFZJCU01DT7LD.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgcctgctccaggagcacctctgggggcacagcggccctgggctgcctggtcaaggctacttcccata

SEQ ID NO: 445341 - DNA, 501 bp, Homo sapiens
  misc_feature: HEFZJCU01B76QI.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 445342 - DNA, 465 bp, Homo sapiens; identical to SEQ ID NO: 444805
  misc_feature: HEFZJCU01AU4EG.19.10.A10.1.454.heavy.3.raw

SEQ ID NO: 445343 - DNA, 523 bp, Homo sapiens
  misc_feature: HEFZJCU01EOKTI.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcggtcttcccctggcaccctcctccagagcacctctgggggcacagcggcctgggctgcctggtacg

SEQ ID NO: 445344 - DNA, 311 bp, Homo sapiens
  misc_feature: HEFZJCU01ANRPB.40.50.E06.1.454.heavy.3.raw
tctagcgactcacgaccggtgctcgatttagatctactgacaacacacaagggcaccgccgaaaaccaggtggaccttagaatgaccaacatggaccctgtggacacaggcacatattactgtgctcacacgtcctacactggctacgactactacggtatggacgtctggggccaggggaccacggtcatcgtctcctcaacctccaccaagggcccatcggtcttccccctggcgccctgctccaggagcacctccgagagcacagcggccctgggctgcctggtcaaggactacttccagtcgctaga

SEQ ID NO: 445345 - DNA, 522 bp, Homo sapiens
  misc_feature: HEFZJCU01BM6XJ.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggcg

SEQ ID NO: 445346 - DNA, 477 bp, Homo sapiens; identical to SEQ ID NO: 444659
  misc_feature: HEFZJCU01BKQXK.16.10.A10.1.454.heavy.3.raw

SEQ ID NO: 445347 - DNA, 309 bp, Homo sapiens; identical to SEQ ID NO: 444418
  misc_feature: HEFZJCU01COYTS.18.53.E09.1.454.heavy.3.raw

SEQ ID NO: 445348 - DNA, 483 bp, Homo sapiens; identical to SEQ ID NO: 444639
  misc_feature: HEFZJCU01CY4H0.11.23.C01.1.454.heavy.3.raw

SEQ ID NO: 445349 - DNA, 483 bp, Homo sapiens; identical to SEQ ID NO: 444639
  misc_feature: HEFZJCU01A9UF3.11.23.C01.1.454.heavy.3.raw

SEQ ID NO: 445350 - DNA, 504 bp, Homo sapiens
  misc_feature: HEFZJCU01BA6EZ.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaaagagggggatacagtggcagctcaagtacttac

SEQ ID NO: 445351 - DNA, 521 bp, Homo sapiens
  misc_feature: HEFZJCU01BHB2Z.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggc

SEQ ID NO: 445352 - DNA, 427 bp, Homo sapiens; identical to SEQ ID NO: 444708
  misc_feature: HEFZJCU01D1N1A.9.34.D01.1.454.heavy.3.raw

SEQ ID NO: 445353 - DNA, 504 bp, Homo sapiens
  misc_feature: HEFZJCU01BNARF.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactactcccactacta

SEQ ID NO: 445354 - DNA, 395 bp, Homo sapiens; identical to SEQ ID NO: 444517
  misc_feature: HEFZJCU01BKKE7.16.68.G02.1.454.heavy.3.raw

SEQ ID NO: 445355 - DNA, 472 bp, Homo sapiens
  misc_feature: HEFZJCU01CSG2I.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgt

SEQ ID NO: 445356 - DNA, 498 bp, Homo sapiens
  misc_feature: HEFZJCU01CO1EZ.10.38.D05.1.454.heavy.3.raw
  modified_base (488)..(488): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagcgtggtttcgtgtagctattcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgaactcgctcaattcnggggccaggg

SEQ ID NO: 445357 - DNA, 490 bp, Homo sapiens; identical to SEQ ID NO: 445139
  misc_feature: HEFZJCU01C4A08.12.75.G09.1.454.heavy.3.raw

SEQ ID NO: 445358 - DNA, 521 bp, Homo sapiens
  misc_feature: HEFZJCU01D9OMX.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagagcacagcggccctgggctgcctggtcaaggactacttcctacg

SEQ ID NO: 445359 - DNA, 495 bp, Homo sapiens
  misc_feature: HEFZJCU01EG7B1.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacagtgct

SEQ ID NO: 445360 - DNA, 516 bp, Homo sapiens
  misc_feature: HEFZJCU01C9OEK.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcggccctgggctgcctggtcaaggctacttccagacgtatca

SEQ ID NO: 445361 - DNA, 506 bp, Homo sapiens; identical to SEQ ID NO: 444696
  misc_feature: HEFZJCU01DI6ZR.16.34.D01.1.454.heavy.3.raw

SEQ ID NO: 445362 - DNA, 486 bp, Homo sapiens
  misc_feature: HEFZJCU01EIMVC.51.38.D05.1.454.heavy.3.raw
cgatcgtatacacgaccggtgctcgatttagtatctgatagttgggtttgggcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgttgcgccaggaagcagtggctggccacatcatgcttttgatatctggagccaagggacaatggtc

SEQ ID NO: 445363 - DNA, 500 bp, Homo sapiens
  misc_feature: HEFZJCU01CRL9Z.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggagcgtct

SEQ ID NO: 445364 - DNA, 389 bp, Homo sapiens
  misc_feature: HEFZJCU01CS7V6.11.20.B09.1.454.heavy.3.raw
cgagagataccacgaccggtgctcgatttagtgtagtgtgaagggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccctgggctgcctggtcaaggactacttccgtatctcctcg

SEQ ID NO: 445365 - DNA, 374 bp, Homo sapiens; identical to SEQ ID NO: 444640
  misc_feature: HEFZJCU01CNWBR.7.37.D04.1.454.heavy.3.raw

SEQ ID NO: 445366 - DNA, 513 bp, Homo sapiens
  misc_feature: HEFZJCU01CL8LS.19.26.C04.1.454.heavy.3.raw
tactctcgtgcacgaccggtgctcgatttagtctagcgactttggggtttgggctgagcggtcggtttcgtcgtaggcgtctttaagtaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacgggctgtgtattactgtgcgagagcgggctggcaactacatccattacggtttggacgtctggggccaaggggaccacggtcatcgtctccccagcctccaccacgggccatcggtcttcccctggcgcctcgctccagg

SEQ ID NO: 445367 - DNA, 400 bp, Homo sapiens
  misc_feature: HEFZJCU01CIVOT.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 445368 - DNA, 490 bp, Homo sapiens; identical to SEQ ID NO: 444500
  misc_feature: HEFZJCU01D3WFE.19.53.E09.1.454.heavy.3.raw

SEQ ID NO: 445369 - DNA, 498 bp, Homo sapiens
  misc_feature: HEFZJCU01DT7E1.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccagggac

SEQ ID NO: 445370 - DNA, 506 bp, Homo sapiens; identical to SEQ ID NO: 444696
  misc_feature: HEFZJCU01D6349.16.34.D01.1.454.heavy.3.raw

SEQ ID NO: 445371 - DNA, 327 bp, Homo sapiens
  misc_feature: HEFZJCU01D1AH7.11.85.H08.1.454.heavy.3.raw
cgagagataccacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccgtatctctcg

SEQ ID NO: 445372 - DNA, 390 bp, Homo sapiens; identical to SEQ ID NO: 444541
  misc_feature: HEFZJCU01B6U9H.16.24.C02.1.454.heavy.3.raw

SEQ ID NO: 445373 - DNA, 403 bp, Homo sapiens
  misc_feature: HEFZJCU01CEF1S.13.72.G06.1.454.heavy.3.raw
tcacgtactacacgaccggtgctcgatttagctacgactgcaagggaaaggggctgcagtgggtcgccactattggtgataatggcagaaacatttactacgcagactccgtgaggggccgcttcaccatctccagagacaattcacggaacacattgtttttacaaattgtcggcctgcgggccgaggacacggccaaatatttttgtgtaaaggatcaatataccagtttggttcgaagtccgtggccttttgactcctggggccagggaaccctggtcaccgtctcctcagcttccaccaagggcccatcggtcttccccctggcgccctgctccaggagcacctctgggggcacagcggccctgggctgcctggtcaaggactacttccgtactagacg

SEQ ID NO: 445374 - DNA, 466 bp, Homo sapiens
  misc_feature: HEFZJCU01C0WEX.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 445375 - DNA, 467 bp, Homo sapiens
  misc_feature: HEFZJCU01EOX09.4.10.A10.1.454.heavy.3.raw
agcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccggtggtgctgagaaacggcgttgacttctggggccagggaaccctggtcaccgtctcctcagcctccaccaagggcccatcggtcttcccctggcgccctgctccaggagcacctccgagagcacagcggccctgggctgcctggtcaaggactacttccctacagtgct

SEQ ID NO: 445376 - DNA, 396 bp, Homo sapiens; identical to SEQ ID NO: 444433
  misc_feature: HEFZJCU01AY78Z.47.59.F04.1.454.heavy.3.raw

SEQ ID NO: 445377 - DNA, 502 bp, Homo sapiens; identical to SEQ ID NO: 444768
  misc_feature: HEFZJCU01BO10U.21.70.G04.1.454.heavy.3.raw

SEQ ID NO: 445378 - DNA, 513 bp, Homo sapiens
  misc_feature: HEFZJCU01DBOHZ.52.40.D07.1.454.heavy.3.raw
cgcagtacgacacgaccggtgctcgatttagtgatagagcgtaacaacagagggacagggtctgtgaagccttcacagaccctgtccctcacctgcactgtctctggtggctccatcaacagtggtagtttcttctggacctggatccggcagcccgccgggaagggactggagtggattgggcgtatccataccagtggcatcaccgagtacaccccttccctcaagagtcgactctccatatcactagacgcgtccaagaaccaggtcttcctgatggtgagctctgtgaccgccgcagactcggccagatattactgtgcgagagcgggggcggctaatgtcgcaggctattacttcggtttggacgtctggggccaagggaccacggtcaccgtctccgcagcctccaccaagggccatcggtcttcccctggcaccctcctccaagagcacctctgggggcacagcggccctgggctgcctggtcaaggactacttcctatacgatcg

SEQ ID NO: 445379 - DNA, 490 bp, Homo sapiens; identical to SEQ ID NO: 444500
  misc_feature: HEFZJCU01BPW8X.19.53.E09.1.454.heavy.3.raw

SEQ ID NO: 445380 - DNA, 396 bp, Homo sapiens
  misc_feature: HEFZJCU01CSSOZ.12.72.G06.1.454.heavy.3.raw
atacgacgtacacgaccggtgctcgatttagctacgactgcaagggaaaggggctggagtgggtctcaggtattagtggaagtggagcaaccacatactacgcagactccgtaaagggccgattcaccatctccagagacaataccaacaacactctgtatctgcaactgaacggcctgagagccgaggacacggccctttattactgtgcgaaagatcgggtaactttagcagcggctggttactttgactactggggccagggaaccctggtcaccgtctcctcagcctccaccaagggcccatcggtcttccccctggcaccctcctccaagagcacctctggggcacagcggccctgggctgcctggtcaaggactacttcctacgtcgtat

SEQ ID NO: 445381 - DNA, 497 bp, Homo sapiens; identical to SEQ ID NO: 444995
  misc_feature: HEFZJCU01B2RO1.4.26.C04.1.454.heavy.3.raw

SEQ ID NO: 445382 - DNA, 486 bp, Homo sapiens; identical to SEQ ID NO: 444861
  misc_feature: HEFZJCU01BUVH5.47.55.E11.1.454.heavy.3.raw

SEQ ID NO: 445383 - DNA, 506 bp, Homo sapiens; identical to SEQ ID NO: 444713
  misc_feature: HEFZJCU01CUH19.5.41.D08.1.454.heavy.3.raw

SEQ ID NO: 445384 - DNA, 402 bp, Homo sapiens; identical to SEQ ID NO: 444815
  misc_feature: HEFZJCU01DETLO.11.70.G04.1.454.heavy.3.raw

SEQ ID NO: 445385 - DNA, 396 bp, Homo sapiens; identical to SEQ ID NO: 444426
  misc_feature: HEFZJCU01CIA45.18.31.C09.1.454.heavy.3.raw

SEQ ID NO: 445386 - DNA, 387 bp, Homo sapiens
  misc_feature: HEFZJCU01COSQU.16.59.F04.1.454.heavy.3.raw
tgtactactccacgaccggtgctcgatttagtacacacacttagggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 445387 - DNA, 519 bp, Homo sapiens; identical to SEQ ID NO: 444867
  misc_feature: HEFZJCU01CE689.9.34.D01.1.454.heavy.3.raw

SEQ ID NO: 445388 - DNA, 497 bp, Homo sapiens
  misc_feature: HEFZJCU01D9TXT.41.71.G05.1.454.heavy.3.raw
tctatactatcacgaccggtgctcgatttagtgtcgtcgcaagagagagggggacccaaaaaccacatccctccttgggagaatcccctagatcacagctcttcaccatggactggacctggagcatccttttcttggtgacagcagcaacaggtgccctatcccaggttcagctggtgcaatctggagctgaggtgaagaagcctggggcctcagtgaaggtctcctgcaagacttctggttacagctttaactcctatggtgtctactgggtgcgacaggcccctggacaggggcttgagtggatgggatggatcaggggttacaatggtaacacagactatgcacagaagttccagggcagaatcaccatgaccacagacgcatcgacgagcacagcctacatggagttgaggagcctgacagctgacgacacggccgtctatttctgtgcgcgggaaagggcaatctcagtcccttctcctatgggctacgtc

SEQ ID NO: 445389 - DNA, 396 bp, Homo sapiens; identical to SEQ ID NO: 444469
  misc_feature: HEFZJCU01BT545.47.46.E02.1.454.heavy.3.raw

SEQ ID NO: 445390 - DNA, 380 bp, Homo sapiens
  misc_feature: HEFZJCU01CV14O.47.77.G11.1.454.heavy.3.raw
agctcacgtacacgaccggtgctcgatttagctagtcactcaagggaaaggggctggagtgggtctcaggcagttggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 445391 - DNA, 497 bp, Homo sapiens
  misc_feature: HEFZJCU01D1SPB.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttccccctggcgccctgctccaggagcacctccgagagcacagcggccctgggctgcctggtcaaggactac

SEQ ID NO: 445392 - DNA, 383 bp, Homo sapiens; identical to SEQ ID NO: 444673
  misc_feature: HEFZJCU01CTUU5.11.61.F06.1.454.heavy.3.raw

SEQ ID NO: 445393 - DNA, 488 bp, Homo sapiens
  misc_feature: HEFZJCU01CHNSY.49.58.F03.1.454.heavy.3.raw
agtcgagagacacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgcaggtgccc

SEQ ID NO: 445394 - DNA, 384 bp, Homo sapiens
  misc_feature: HEFZJCU01D766F.22.46.E02.1.454.heavy.3.raw
acatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccagacgtatca

SEQ ID NO: 445395 - DNA, 516 bp, Homo sapiens
  misc_feature: HEFZJCU01AHRIH.12.55.E11.1.454.heavy.3.raw
atacgacgtacacgaccggtgctcgatttagcactcgcacgttgggttttcctcgttgctcttttaagaggtgtccagtgtcagatgcagctggtggagtctggggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctcggcgccctgctccaggagcacctctgggggcacagcggcccg

SEQ ID NO: 445396 - DNA, 396 bp, Homo sapiens; identical to SEQ ID NO: 444469
  misc_feature: HEFZJCU01D63XE.47.46.E02.1.454.heavy.3.raw

SEQ ID NO: 445397 - DNA, 512 bp, Homo sapiens
  misc_feature: HEFZJCU01A0S3Z.4.25.C03.1.454.heavy.3.raw
agcactgtagcacgaccggtgctcgatttagtagtgtagatttgggtttgggctgagcgtggtttcgtcgtaggctctttaagaggtgtccagtgtcacgtgcgcctggtggagtctggggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggctacggtcaccgtctcctcagcctccaccaagggcccatcggtcttcccctggca

SEQ ID NO: 445398 - DNA, 437 bp, Homo sapiens; identical to SEQ ID NO: 444603
  misc_feature: HEFZJCU01D7RN0.3.21.B10.1.454.heavy.3.raw

SEQ ID NO: 445399 - DNA, 504 bp, Homo sapiens
  misc_feature: HEFZJCU01DZRTT.17.74.G08.1.454.heavy.3.raw
cgtagactagcacgaccggtgctcgatttagtagctctatcagggtcttcgtggctcacgtccaccaccacgcatgtgacctcaggggtccctgagactctcctgtgcagcctctggattcaccttcagtacctactggatgcactgggtccgccaagctccagggaaggggctggagtggctctcacgtgttgataatgttggcagtttcacaaaatacgcggactccgtgaagggccgattcaccatctccagagacaacgccaagaacacgctgtatctgcaaatgaacagtctgagagccgaggacacggctgtttattactgtgcaagacagcactacagtcactacttcgacccctggggccagggaaccctggtcaccgtctcctcagcctccaccaagggcccatcggtcttccccctggcaccctcctccaagagcacctctgggggcacagcggccctgggctgcctggtcaaggactacttccctagtctacg

SEQ ID NO: 445400 - DNA, 497 bp, Homo sapiens
  misc_feature: HEFZJCU01DARLH.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 445401 - DNA, 507 bp, Homo sapiens
  misc_feature: HEFZJCU01EP8WU.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctgctccaggacg

SEQ ID NO: 445402 - DNA, 521 bp, Homo sapiens; identical to SEQ ID NO: 445317
  misc_feature: HEFZJCU01A11EQ.12.40.D07.1.454.heavy.3.raw

SEQ ID NO: 445403 - DNA, 337 bp, Homo sapiens
  misc_feature: HEFZJCU01EVLS6.51.45.E01.1.454.heavy.3.raw
cgatcgtatacacgaccggtgctcgatttagtgagtcagtaagggaaagggcccgattcgccatctccagagacaattccaaaaataccctctatctgcgaatgaacagcctgcgacctgaagacacggctatatatttctgtgcgagaggggagtcttattgtaatgatggttcctgctatcgttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 445404 - DNA, 529 bp, Homo sapiens
  misc_feature: HEFZJCU01CR7S6.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagccctccatggaattgaccacactgaaatctgacgacacggccgtctactattgtgcgagggtcaatagtcttaccataaacggtgcccggacagatgtatttttggatgtcgtggggccaaggtacagcggtcaccgtcgcctcacgcctccaccgaacgggcccatcggtcttcccctggccaccctcctccaagacgcacctcgtgggggcacgac

SEQ ID NO: 445405 - DNA, 489 bp, Homo sapiens; identical to SEQ ID NO: 444791
  misc_feature: HEFZJCU01B8DHF.47.85.H08.1.454.heavy.3.raw

SEQ ID NO: 445406 - DNA, 483 bp, Homo sapiens; identical to SEQ ID NO: 444639
  misc_feature: HEFZJCU01B3ZRB.11.23.C01.1.454.heavy.3.raw

SEQ ID NO: 445407 - DNA, 489 bp, Homo sapiens; identical to SEQ ID NO: 444791
  misc_feature: HEFZJCU01BL19U.47.85.H08.1.454.heavy.3.raw

SEQ ID NO: 445408 - DNA, 431 bp, Homo sapiens
  misc_feature: HEFZJCU01B64NJ.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattacacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 445409 - DNA, 456 bp, Homo sapiens; identical to SEQ ID NO: 444898
  misc_feature: HEFZJCU01EJSWM.10.38.D05.1.454.heavy.3.raw

SEQ ID NO: 445410 - DNA, 396 bp, Homo sapiens; identical to SEQ ID NO: 444469
  misc_feature: HEFZJCU01DYU1S.47.46.E02.1.454.heavy.3.raw

SEQ ID NO: 445411 - DNA, 464 bp, Homo sapiens; identical to SEQ ID NO: 445062
  misc_feature: HEFZJCU01BU0KP.19.10.A10.1.454.heavy.3.raw

SEQ ID NO: 445412 - DNA, 391 bp, Homo sapiens
  misc_feature: HEFZJCU01C5EPA.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctgggccagggaaccctggtcaccgtctcctcagcctccaccaagggcccatcggtcttccccctggcgccctgctccaggagcacctccgagagcacagcggccctgggctgcctggtcaaggactacttcctagagacacg

SEQ ID NO: 445413 - DNA, 497 bp, Homo sapiens
  misc_feature: HEFZJCU01DCB9X.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccaggggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 445414 - DNA, 502 bp, Homo sapiens
  misc_feature: HEFZJCU01EXSRS.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttct

SEQ ID NO: 445415 - DNA, 509 bp, Homo sapiens
  misc_feature: HEFZJCU01DF6XJ.49.77.G11.1.454.heavy.3.raw
agtcgagagacacgaccggtgctcgatttagctagtcactcaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctggcaccctcctccaagagcacctctgggggcacagcggccctgggctgcctggtcaaggactacttcctctctcgact

SEQ ID NO: 445416 - DNA, 480 bp, Homo sapiens; identical to SEQ ID NO: 444657
  misc_feature: HEFZJCU01BC7MV.19.67.G01.1.454.heavy.3.raw

SEQ ID NO: 445417 - DNA, 396 bp, Homo sapiens; identical to SEQ ID NO: 444469
  misc_feature: HEFZJCU01CPNAT.47.46.E02.1.454.heavy.3.raw

SEQ ID NO: 445418 - DNA, 396 bp, Homo sapiens
  misc_feature: HEFZJCU01C3R1C.16.68.G02.1.454.heavy.3.raw
tgtactactccacgaccggtgctcgatttagtcgatagtgaagggaaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtagacgtacttccgtacgtagtaca

SEQ ID NO: 445419 - DNA, 437 bp, Homo sapiens; identical to SEQ ID NO: 444603
  misc_feature: HEFZJCU01BAJS0.3.21.B10.1.454.heavy.3.raw

SEQ ID NO: 445420 - DNA, 379 bp, Homo sapiens; identical to SEQ ID NO: 444450
  misc_feature: HEFZJCU01EGVO4.47.77.G11.1.454.heavy.3.raw

SEQ ID NO: 445421 - DNA, 422 bp, Homo sapiens
  misc_feature: HEFZJCU01CXWTR.51.41.D08.1.454.heavy.3.raw
cgatcgtatacacgaccggtgctcgatttagtcacgcgagaaagggaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 445422 - DNA, 515 bp, Homo sapiens
  misc_feature: HEFZJCU01CJZU4.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggcccg

SEQ ID NO: 445423 - DNA, 518 bp, Homo sapiens
  misc_feature: HEFZJCU01CYGK5.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 445424 - DNA, 391 bp, Homo sapiens; identical to SEQ ID NO: 444514
  misc_feature: HEFZJCU01ACT9B.12.24.C02.1.454.heavy.3.raw

SEQ ID NO: 445425 - DNA, 506 bp, Homo sapiens
  misc_feature: HEFZJCU01A7L1Y.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactacta

SEQ ID NO: 445426 - DNA, 345 bp, Homo sapiens
  misc_feature: HEFZJCU01EFHE5.49.64.F09.1.454.heavy.3.raw
agtcgagagacacgaccggtgctcgatttagcgcgtatacaagggcagatttatcatctcaagagacgattccaaaggcatcgcctatctgcaaatgaacagcctgaaaaccgaggacacagccgtgtatttttgtactagagtcttcttgtattaccatgatactagtggttttacaggagcggggcacggtatggacgtctggggccaagggaccacggtcaccatctcctcagcctccaccaagggcccatcggtcttccccctggcaccctcctccaagagcacctctgggggcacagcggccctgggctgcctggtcaaggactacttcctctctcgact

SEQ ID NO: 445427 - DNA, 519 bp, Homo sapiens
  misc_feature: HEFZJCU01CIGOM.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttttgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 445428 - DNA, 497 bp, Homo sapiens
  misc_feature: HEFZJCU01CHVB9.47.85.H08.1.454.heavy.3.raw
agctcacgtacacgaccggtgctcgatttagtatcactcagtcgcggggagctctgggagagggagcccgagacgactggaaagttcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 445429 - DNA, 488 bp, Homo sapiens; identical to SEQ ID NO: 444617
  misc_feature: HEFZJCU01AOYND.4.6.A06.1.454.heavy.3.raw

SEQ ID NO: 445430 - DNA, 490 bp, Homo sapiens; identical to SEQ ID NO: 444500
  misc_feature: HEFZJCU01ECXN2.19.53.E09.1.454.heavy.3.raw

SEQ ID NO: 445431 - DNA, 381 bp, Homo sapiens
  misc_feature: HEFZJCU01DLWUD.3.70.G04.1.454.heavy.3.raw
agacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 445432 - DNA, 483 bp, Homo sapiens; identical to SEQ ID NO: 444924
  misc_feature: HEFZJCU01A4EEF.10.35.D02.1.454.heavy.3.raw

SEQ ID NO: 445433 - DNA, 400 bp, Homo sapiens
  misc_feature: HEFZJCU01BM3PM.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggtcgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 445434 - DNA, 482 bp, Homo sapiens
  misc_feature: HEFZJCU01AKXAJ.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggagtatagc

SEQ ID NO: 445435 - DNA, 487 bp, Homo sapiens; identical to SEQ ID NO: 445077
  misc_feature: HEFZJCU01EEE1Y.47.85.H08.1.454.heavy.3.raw

SEQ ID NO: 445436 - DNA, 504 bp, Homo sapiens
  misc_feature: HEFZJCU01C5SVG.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggaaggggctagaatgggtctcaagtatcacaagcagtagtagtaccgcatggtacgcagactccgtgaagggccgtttcaccatctccagagacaattccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 445437 - DNA, 516 bp, Homo sapiens
  misc_feature: HEFZJCU01EXZML.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactacttcc

SEQ ID NO: 445438 - DNA, 336 bp, Homo sapiens
  misc_feature: HEFZJCU01BRHXL.49.29.C07.1.454.heavy.3.raw
agtcgagagacacgaccggtgctcgatttagagtgctacgaagggaaagggccgattcatcatctccagagacaactccgagaacacgctgtatctgcaaatgaacaggctgagagctgaagacacggctttatattactgtgcgaacttaatcacggaggacaacggtgaccccgtccgctcggtgcggaggtctggggccaagggaccacggtcatcgtctcctcagcctccaccaagggcccatcggtcttcccctggcaccctcctccaagagcacctctggggcacagcggccctgggctgcctggtcaaggactacttcctctctcgact

SEQ ID NO: 445439 - DNA, 500 bp, Homo sapiens; identical to SEQ ID NO: 445028
  misc_feature: HEFZJCU01DRR3U.13.12.B01.1.454.heavy.3.raw

SEQ ID NO: 445440 - DNA, 518 bp, Homo sapiens
  misc_feature: HEFZJCU01ED4WO.40.33.C11.1.454.heavy.3.raw
tctagcgactcacgaccggtgctcgatttagagtgagctcgttgggtttgggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttcccctggcgccctgctccaggagcacctcccgagagcacagcggccctgggctgcctggtcaaggactacttccagtcg

SEQ ID NO: 445441 - DNA, 322 bp, Homo sapiens
  misc_feature: HEFZJCU01D10IT.47.38.D05.1.454.heavy.3.raw
agctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtgggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 445442 - DNA, 506 bp, Homo sapiens; identical to SEQ ID NO: 445425
  misc_feature: HEFZJCU01CVU3P.10.38.D05.1.454.heavy.3.raw

SEQ ID NO: 445443 - DNA, 500 bp, Homo sapiens; identical to SEQ ID NO: 444529
  misc_feature: HEFZJCU01ERBL8.12.38.D05.1.454.heavy.3.raw

SEQ ID NO: 445444 - DNA, 372 bp, Homo sapiens
  misc_feature: HEFZJCU01DKGSS.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttcccctggcgccctgctccaggagcacctccgagagcacagcggccctggctgcctggtcaaggactacttcctagagacacg

SEQ ID NO: 445445 - DNA, 492 bp, Homo sapiens; identical to SEQ ID NO: 444695
  misc_feature: HEFZJCU01BMOV9.3.34.D01.1.454.heavy.3.raw

SEQ ID NO: 445446 - DNA, 328 bp, Homo sapiens
  misc_feature: HEFZJCU01BXM3Y.19.85.H08.1.454.heavy.3.raw
tactctcgtgcacgaccggtgctcgatttagtatcactcagtcgcggggccggtttaccatctccagagacaatgtcaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaagggcccatcggtcttccccctggcaccctcctccaagagcacctctgggggcacagcggccctgggctgcctggtcaaggactacttcccacgagagta

SEQ ID NO: 445447 - DNA, 379 bp, Homo sapiens; identical to SEQ ID NO: 444450
  misc_feature: HEFZJCU01DNAJW.47.77.G11.1.454.heavy.3.raw

SEQ ID NO: 445448 - DNA, 313 bp, Homo sapiens; identical to SEQ ID NO: 444428
  misc_feature: HEFZJCU01CUQ4N.11.59.F04.1.454.heavy.3.raw

SEQ ID NO: 445449 - DNA, 371 bp, Homo sapiens
  misc_feature: HEFZJCU01DEXHI.3.42.D09.1.454.heavy.3.raw
agacgcactccacgaccggtgctcgatttagacacatacgcagggaaaggggctggagtggattgggagtttctattatggtggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 445450 - DNA, 518 bp, Homo sapiens; identical to SEQ ID NO: 445423
  misc_feature: HEFZJCU01DHFBO.7.78.H01.1.454.heavy.3.raw

SEQ ID NO: 445451 - DNA, 371 bp, Homo sapiens; identical to SEQ ID NO: 444435
  misc_feature: HEFZJCU01BWVNQ.3.42.D09.1.454.heavy.3.raw

SEQ ID NO: 445452 - DNA, 506 bp, Homo sapiens
  misc_feature: HEFZJCU01DL1YP.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 445453 - DNA, 518 bp, Homo sapiens
  misc_feature: HEFZJCU01CVDUB.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 445454 - DNA, 477 bp, Homo sapiens; identical to SEQ ID NO: 444659
  misc_feature: HEFZJCU01C0PPD.16.10.A10.1.454.heavy.3.raw

SEQ ID NO: 445455 - DNA, 488 bp, Homo sapiens
  misc_feature: HEFZJCU01CD8L8.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggtcggttctccatctccagagacacttccaagaacacggtgtatctgcaagtgcacagcctgagagccgaggacacggccatatattactgtgcgaaagatcgattccccctccgtagagatggctacaaaatctttctccgaattgacttctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 445456 - DNA, 403 bp, Homo sapiens
  misc_feature: HEFZJCU01A3744.3.72.G06.1.454.heavy.3.raw
agacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccgagtgcgtct

SEQ ID NO: 445457 - DNA, 379 bp, Homo sapiens; identical to SEQ ID NO: 444450
  misc_feature: HEFZJCU01CZNM8.47.77.G11.1.454.heavy.3.raw

SEQ ID NO: 445458 - DNA, 487 bp, Homo sapiens
  misc_feature: HEFZJCU01BBZN4.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaggactacttcccatctcgta

SEQ ID NO: 445459 - DNA, 506 bp, Homo sapiens
  misc_feature: HEFZJCU01AVKR3.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgtttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagacacggtgtatctgcaaatgaacagcctgagagccgaggacacggccacatattactgtgcgaaagatctcgggctggttccgcggtccggg

SEQ ID NO: 445460 - DNA, 488 bp, Homo sapiens
  misc_feature: HEFZJCU01D2QN8.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactactcctacgtgagct

SEQ ID NO: 445461 - DNA, 518 bp, Homo sapiens
  misc_feature: HEFZJCU01B06D2.49.25.C03.1.454.heavy.3.raw
agtcgagagacacgaccggtgctcgatttagtagtgtagatttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggcaccctcctccaagagcacctctgggggcacagcggccctgggctgcctggtcaaggactacttcctctctcgact

SEQ ID NO: 445462 - DNA, 400 bp, Homo sapiens; identical to SEQ ID NO: 444452
  misc_feature: HEFZJCU01DZ2F4.47.24.C02.1.454.heavy.3.raw

SEQ ID NO: 445463 - DNA, 351 bp, Homo sapiens
  misc_feature: HEFZJCU01AZ453.49.4.A04.1.454.heavy.3.raw
agtcgagagacacgaccggtgctcgatttagagtagtgatcagggacattgactccgtgaagggccgattcatcatctccagagacaactccgagaacacactgtatcttcaaatgaacaggttgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctggggcacagcggccctgggctgcctggtcaaggactacttcctctctcgact

SEQ ID NO: 445464 - DNA, 506 bp, Homo sapiens
  misc_feature: HEFZJCU01DXS4K.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctggctgcctggtcaggactacttccagacgtatca

SEQ ID NO: 445465 - DNA, 490 bp, Homo sapiens; identical to SEQ ID NO: 444500
  misc_feature: HEFZJCU01DB1GN.19.53.E09.1.454.heavy.3.raw

SEQ ID NO: 445466 - DNA, 374 bp, Homo sapiens; identical to SEQ ID NO: 444640
  misc_feature: HEFZJCU01A6P05.7.37.D04.1.454.heavy.3.raw

SEQ ID NO: 445467 - DNA, 503 bp, Homo sapiens; identical to SEQ ID NO: 444557
  misc_feature: HEFZJCU01CZ4I4.9.33.C11.1.454.heavy.3.raw

SEQ ID NO: 445468 - DNA, 518 bp, Homo sapiens; identical to SEQ ID NO: 444718
  misc_feature: HEFZJCU01D8523.9.34.D01.1.454.heavy.3.raw

SEQ ID NO: 445469 - DNA, 470 bp, Homo sapiens
  misc_feature: HEFZJCU01DFDDM.14.26.C04.1.454.heavy.3.raw
cgtctagtaccacgaccggtgctcgatttagtctagcgactttgggtttggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttgggtttaaaacttttgactattggggccagggaaccctggtcaccgtctcctcagcctccaccaagggcccatcggtcttcccctggcgccctgctccaggagcacctccgagagcacagcggccctgggctgcctggtcaaggactacttccgtactagacg

SEQ ID NO: 445470 - DNA, 395 bp, Homo sapiens; identical to SEQ ID NO: 445227
  misc_feature: HEFZJCU01AXGQ7.47.46.E02.1.454.heavy.3.raw

SEQ ID NO: 445471 - DNA, 520 bp, Homo sapiens
  misc_feature: HEFZJCU01D5FQW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtctcccctggcg

SEQ ID NO: 445472 - DNA, 309 bp, Homo sapiens
  misc_feature: HEFZJCU01C2H9V.18.17.B06.1.454.heavy.3.raw
tacgagtatgcacgaccggtgctcgatttagtcgatagtgaagggccgattcaccatctccagagacgattccaagaacacgttgtatcttcaaatgaacagcctgacagtcgacgacacggccatgtatttttgtgcgagcgacccggggctcctcaatggctttcattactggggccagggaaccctagtcaccgtcgccgcagcctccaccaagggcccatcggtcttccccctggcgccctgctccaggagcacctccgagacggccctgggctgcctggtcaaggactacttcccatactcgta

SEQ ID NO: 445473 - DNA, 482 bp, Homo sapiens; identical to SEQ ID NO: 444904
  misc_feature: HEFZJCU01EM3AG.47.59.F04.1.454.heavy.3.raw

SEQ ID NO: 445474 - DNA, 505 bp, Homo sapiens
  misc_feature: HEFZJCU01BAD46.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctggctgcctggtcaaggactacttccgagtagtaca

SEQ ID NO: 445475 - DNA, 378 bp, Homo sapiens; identical to SEQ ID NO: 444463
  misc_feature: HEFZJCU01DVD55.47.77.G11.1.454.heavy.3.raw

SEQ ID NO: 445476 - DNA, 536 bp, Homo sapiens
  misc_feature: HEFZJCU01DRY15.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcgacacgcggcccgtcggcggtcgccgtcgtcgacggaacgtaccttacctacgacgtactacacc

SEQ ID NO: 445477 - DNA, 381 bp, Homo sapiens
  misc_feature: HEFZJCU01BJJU3.22.85.H08.1.454.heavy.3.raw
acatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctcccaccctccaccaagggcccatcggtcttccccctggcaccctcctccaagagcacctctgggggcacagcggccctgggctgcctggtcaaggactacttccacgcgtatgt

SEQ ID NO: 445478 - DNA, 335 bp, Homo sapiens; identical to SEQ ID NO: 445273
  misc_feature: HEFZJCU01EIJQV.51.9.A09.1.454.heavy.3.raw

SEQ ID NO: 445479 - DNA, 516 bp, Homo sapiens
  misc_feature: HEFZJCU01DSP2G.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcggccctggctgcctggtcaaggactacttccagacgtatca

SEQ ID NO: 445480 - DNA, 524 bp, Homo sapiens
  misc_feature: HEFZJCU01CI8UB.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtacctcggatggtttgatttctggggccaaggga

SEQ ID NO: 445481 - DNA, 527 bp, Homo sapiens
  misc_feature: HEFZJCU01DCZZT.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggacctctggacaaggccttgagtggatgggaaggatcggtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccttgacttctggggccatggaacccggtcc

SEQ ID NO: 445482 - DNA, 372 bp, Homo sapiens; identical to SEQ ID NO: 444727
  misc_feature: HEFZJCU01D1SR7.3.42.D09.1.454.heavy.3.raw

SEQ ID NO: 445483 - DNA, 384 bp, Homo sapiens; identical to SEQ ID NO: 444556
  misc_feature: HEFZJCU01DRXAZ.22.46.E02.1.454.heavy.3.raw

SEQ ID NO: 445484 - DNA, 482 bp, Homo sapiens
  misc_feature: HEFZJCU01AYIV5.2.33.C11.1.454.heavy.3.raw
acgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctggcgccctgctccaggagcacctccgagagcacagcggccctgggctgcctggtcaaggactacttcctgtcgagcgt

SEQ ID NO: 445485 - DNA, 375 bp, Homo sapiens; identical to SEQ ID NO: 444459
  misc_feature: HEFZJCU01B0NCA.48.59.F04.1.454.heavy.3.raw

SEQ ID NO: 445486 - DNA, 414 bp, Homo sapiens
  misc_feature: HEFZJCU01EVLLD.51.1.A01.1.454.heavy.3.raw
cgatcgtatacacgaccggtgctcgatttagacgtctcatcaagggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagagggagaatcactactttgacctactggggccagggaagactggtcaccgtctcctccgcctccaccaagggcccatcggtcttccccctggcaccctcctccaagagcacctctgggggcacagcggccctgggctgcctggtcaaggactacttcctcgtagcact

SEQ ID NO: 445487 - DNA, 395 bp, Homo sapiens; identical to SEQ ID NO: 444517
  misc_feature: HEFZJCU01C2MTV.16.68.G02.1.454.heavy.3.raw

SEQ ID NO: 445488 - DNA, 313 bp, Homo sapiens
  misc_feature: HEFZJCU01D8QPC.49.8.A08.1.454.heavy.3.raw
agtcgagagacacgaccggtgctcgatttagcatactctacagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 445489 - DNA, 518 bp, Homo sapiens
  misc_feature: HEFZJCU01ESGQW.12.40.D07.1.454.heavy.3.raw
atacgacgtacacgaccggtgctcgatttagtgatagagcgtaacaacagagggctcaccatggagtttgggctgagcgtggtttcgtcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagcacacgaacctactggccatactatgggggcttgttctggggccaggggaccctggtcatcgtctccccagcctccaccaagggcccatcggtcttcccctggcg

SEQ ID NO: 445490 - DNA, 379 bp, Homo sapiens; identical to SEQ ID NO: 444450
  misc_feature: HEFZJCU01EQV4K.47.77.G11.1.454.heavy.3.raw

SEQ ID NO: 445491 - DNA, 396 bp, Homo sapiens; identical to SEQ ID NO: 444469
  misc_feature: HEFZJCU01EBV91.47.46.E02.1.454.heavy.3.raw

SEQ ID NO: 445492 - DNA, 483 bp, Homo sapiens; identical to SEQ ID NO: 444924
  misc_feature: HEFZJCU01ECTVI.10.35.D02.1.454.heavy.3.raw

SEQ ID NO: 445493 - DNA, 400 bp, Homo sapiens
  misc_feature: HEFZJCU01DTJJJ.13.4.A04.1.454.heavy.3.raw
tcacgtactacacgaccggtgctcgatttagagtagtgatcagggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 445494 - DNA, 490 bp, Homo sapiens; identical to SEQ ID NO: 445139
  misc_feature: HEFZJCU01CHRVI.12.75.G09.1.454.heavy.3.raw

SEQ ID NO: 445495 - DNA, 494 bp, Homo sapiens
  misc_feature: HEFZJCU01CU6WS.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacgggaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 445496 - DNA, 339 bp, Homo sapiens
  misc_feature: HEFZJCU01A2NJG.48.70.G04.1.454.heavy.3.raw
agtatacatacacgaccggtgctcgatttagtgtagtgtgaagggaaagggcagagtcacgattaccgcggacaaatccacgagcacagcctacatggagctgagcagcctgagatctgaggacacggccgtgtattactgtgcgagagatcagagtggttattatctccgtgggtactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatgtatact

SEQ ID NO: 445497 - DNA, 391 bp, Homo sapiens; identical to SEQ ID NO: 444514
  misc_feature: HEFZJCU01D8IZK.12.24.C02.1.454.heavy.3.raw

SEQ ID NO: 445498 - DNA, 518 bp, Homo sapiens; identical to SEQ ID NO: 444718
  misc_feature: HEFZJCU01EZBHA.9.34.D01.1.454.heavy.3.raw

SEQ ID NO: 445499 - DNA, 375 bp, Homo sapiens; identical to SEQ ID NO: 444459
  misc_feature: HEFZJCU01BMSNU.48.59.F04.1.454.heavy.3.raw

SEQ ID NO: 445500 - DNA, 379 bp, Homo sapiens; identical to SEQ ID NO: 444450
  misc_feature: HEFZJCU01DPAUA.47.77.G11.1.454.heavy.3.raw

SEQ ID NO: 445501 - DNA, 496 bp, Homo sapiens
  misc_feature: HEFZJCU01BYSWA.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaggactacg

SEQ ID NO: 445502 - DNA, 487 bp, Homo sapiens
  misc_feature: HEFZJCU01BTB25.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggcgccctgctccaggagcacctccgagagcacagcggccctgggctgcctgtcaaggactacttcctacgtgagct

SEQ ID NO: 445503 - DNA, 384 bp, Homo sapiens
  misc_feature: HEFZJCU01ED750.48.49.E05.1.454.heavy.3.raw
agtatacatacacgaccggtgctcgatttagagcgactagcaacacacaaagggagatggaagtaagacatactatgcggattctgtgaagggccgattcaccatctccagagacaacgccaaggagtcactgtatctgcagatgaacagcctgagagccgaggacgcggctgtgtattactgtgcgagagatgtgaatccctttgatagtagtggtcgttactatgatgctttggatatgtggggccaagggacaacggtcaccgtctcttcagcctccaccaagggcccatcggtcttccccctggcgccctgctccaggagcacctccgagagcacagcggccctgggctgcctggtcaaggactacttcctatgtatact

SEQ ID NO: 445504 - DNA, 526 bp, Homo sapiens
  misc_feature: HEFZJCU01EZ6GE.49.67.G01.1.454.heavy.3.raw
agtcgagagacacgaccggtgctcgatttagagtatacatattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtaacagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctgcctccaccg

SEQ ID NO: 445505 - DNA, 477 bp, Homo sapiens; identical to SEQ ID NO: 444659
  misc_feature: HEFZJCU01ESY00.16.10.A10.1.454.heavy.3.raw

SEQ ID NO: 445506 - DNA, 518 bp, Homo sapiens
  misc_feature: HEFZJCU01DXWJS.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtgaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 445507 - DNA, 488 bp, Homo sapiens
  misc_feature: HEFZJCU01EYRQ1.4.53.E09.1.454.heavy.3.raw
agcactgtagcacgaccggtgctcgatttagagagagtgtgttgggtttggggggtccctgagactctcctgtacagtctctgcatctaccttcacttctttttggatgacctggctccgccgggctccagggagggggctggagtgggtggccaccatcaatcaagatggaagtgagagaacctatgtggactctgtgaagggccgattcaccatctccagagacaacgccaagaattctctgtatctgcaaatgaacagcctgagagccgaggactcggctgtctattactgtgcgaggaagaagtattactatgatacaagtgacatgggctggttcgacccctggggccagggaaccctggtcaccgtctcctcagcctccaccaagggcccatcggtcttcccctggcgccctgctccaggagcacctccgagagcacagcggccctgggctgcctggtcaaggactacttccctacagtgct

SEQ ID NO: 445508 - DNA, 510 bp, Homo sapiens
  misc_feature: HEFZJCU01DS5D1.22.86.H09.1.454.heavy.3.raw
acatacgcgtcacgaccggtgctcgatttagtgctatagacttgggtttgggctgagcgtgggttttccgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggacaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccaagggacactggtcaccgtctcttcagcctccaccaagggcccatcggtcttcccctggcgccctgctccaggacg

SEQ ID NO: 445509 - DNA, 390 bp, Homo sapiens; identical to SEQ ID NO: 444654
  misc_feature: HEFZJCU01CMFI3.16.17.B06.1.454.heavy.3.raw

SEQ ID NO: 445510 - DNA, 511 bp, Homo sapiens
  misc_feature: HEFZJCU01EIOYU.15.86.H09.1.454.heavy.3.raw
tctacgtagccacgaccggtgctcgatttagtgctatagacttgggtttggggggaagaggaagactgacggtcccttagagtctcctgtgtggcctctggattcactttcagtaatggctggatgagttgggtccgccaggctccagggaaggggctggagtgggttggacgtttcaaaagtaaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgcttttgatatctggggcccagggacaatggtcgtcgtctcttcagcctccaccaagggcccatcggtcttcccctggcaccctcctcccaagagcacctctgggggcacagcggccctgggctgcctggtcaaggactacttccgctacgtaga

SEQ ID NO: 445511 - DNA, 465 bp, Homo sapiens; identical to SEQ ID NO: 444805
  misc_feature: HEFZJCU01C58CZ.19.10.A10.1.454.heavy.3.raw

SEQ ID NO: 445512 - DNA, 465 bp, Homo sapiens; identical to SEQ ID NO: 445132
  misc_feature: HEFZJCU01EYRDM.5.86.H09.1.454.heavy.3.raw

SEQ ID NO: 445513 - DNA, 463 bp, Homo sapiens
  misc_feature: HEFZJCU01BO1HJ.2.28.C06.1.454.heavy.3.raw
acgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 445514 - DNA, 390 bp, Homo sapiens
  misc_feature: HEFZJCU01C78M5.13.46.E02.1.454.heavy.3.raw
tcacgtactacacgaccggtgctcgatttagactcatctacagggaaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctggggccaagggaccacggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 445515 - DNA, 395 bp, Homo sapiens; identical to SEQ ID NO: 444494
  misc_feature: HEFZJCU01BEX7I.47.46.E02.1.454.heavy.3.raw

SEQ ID NO: 445516 - DNA, 505 bp, Homo sapiens
  misc_feature: HEFZJCU01B27B3.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcagcctccaccaaggcccatcggtcttcccctggcaccctcct

SEQ ID NO: 445517 - DNA, 481 bp, Homo sapiens
  misc_feature: HEFZJCU01AF9AD.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccagacgtatca

SEQ ID NO: 445518 - DNA, 514 bp, Homo sapiens
  misc_feature: HEFZJCU01BS6YI.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagaatccgtgaagggccgcttcaccatctccagagacaattccaagaacacggtgtatctgcaaatgaacagcctgagagccgaggacacggccacatattactgtgcgaaagatctcgggctggtttccggcggtccggggta

SEQ ID NO: 445519 - DNA, 412 bp, Homo sapiens; identical to SEQ ID NO: 444705
  misc_feature: HEFZJCU01DOESX.51.60.F05.1.454.heavy.3.raw

SEQ ID NO: 445520 - DNA, 482 bp, Homo sapiens
  misc_feature: HEFZJCU01CWYAC.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaaggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 445521 - DNA, 521 bp, Homo sapiens; identical to SEQ ID NO: 445358
  misc_feature: HEFZJCU01EQYHV.12.71.G05.1.454.heavy.3.raw

SEQ ID NO: 445522 - DNA, 527 bp, Homo sapiens
  misc_feature: HEFZJCU01D1VP4.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggcaccctcctccaagagcacctctgggggcacagcggccctgggctg

SEQ ID NO: 445523 - DNA, 524 bp, Homo sapiens
  misc_feature: HEFZJCU01EZZ0Q.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaagcggtggcctatcggggtggttttgatgtctggggccaagggacattggtcaccgtctcttcagcctccaccaagggcccatcggtcttcccctcggcaccctcctccaagagcacctctgggggcacagcggccctc

SEQ ID NO: 445524 - DNA, 315 bp, Homo sapiens
  misc_feature: HEFZJCU01BH1K7.13.17.B06.1.454.heavy.3.raw
tcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 445525 - DNA, 379 bp, Homo sapiens; identical to SEQ ID NO: 444450
  misc_feature: HEFZJCU01ELS4I.47.77.G11.1.454.heavy.3.raw

SEQ ID NO: 445526 - DNA, 339 bp, Homo sapiens; identical to SEQ ID NO: 444436
  misc_feature: HEFZJCU01CAOAT.47.38.D05.1.454.heavy.3.raw

SEQ ID NO: 445527 - DNA, 492 bp, Homo sapiens
  misc_feature: HEFZJCU01D7NOX.51.6.A06.1.454.heavy.3.raw
  modified_base (484)..(484): a, c, t, g, unknown or other
cgatcgtatacacgaccggtgctcgatttagatctactgacagggggctctgggagacgagcccagcactggaagtcgccggtgtttccattcggtgatcatcactgaacacagaggactcaccatggagtttgggctgagcggtggtttcgtcgtaggcgtctttaagtaggtgtcagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaaataaatactacgcagactccgtgaagggccgattcaccatctccagagacaatcccaagaacacactttatctgcaaatgaaacaccctgagacttgaggacacggctgtctattattgtgcgagagggganatcgatca

SEQ ID NO: 445528 - DNA, 517 bp, Homo sapiens
  misc_feature: HEFZJCU01E1RHS.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgtaccagtgggccggggaacccgtggtcaccgtctcttcagcctccaccaaggcccatcggtcttcccctggcacctcctccaagagcacctctggggcacagcc

SEQ ID NO: 445529 - DNA, 483 bp, Homo sapiens; identical to SEQ ID NO: 444924
  misc_feature: HEFZJCU01CWRSZ.10.35.D02.1.454.heavy.3.raw

SEQ ID NO: 445530 - DNA, 526 bp, Homo sapiens
  misc_feature: HEFZJCU01CC1GX.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccctgggcg

SEQ ID NO: 445531 - DNA, 491 bp, Homo sapiens
  misc_feature: HEFZJCU01DLYB3.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 445532 - DNA, 373 bp, Homo sapiens
  misc_feature: HEFZJCU01BL9C8.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttcccctggcgccctgctccaggagcacctccgagagcacagcggccctgggctgcctggtcaaggactacttcctagagacacg

SEQ ID NO: 445533 - DNA, 464 bp, Homo sapiens
  misc_feature: HEFZJCU01CZQ40.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttcccctggcgccctgctccaggagcacctccgagagcacagcggccctgggctgcctggtcaaggactacttcccacgagagta

SEQ ID NO: 445534 - DNA, 465 bp, Homo sapiens; identical to SEQ ID NO: 444805
  misc_feature: HEFZJCU01DYO68.19.10.A10.1.454.heavy.3.raw

SEQ ID NO: 445535 - DNA, 509 bp, Homo sapiens; identical to SEQ ID NO: 444586
  misc_feature: HEFZJCU01B76IZ.12.78.H01.1.454.heavy.3.raw

SEQ ID NO: 445536 - DNA, 469 bp, Homo sapiens
  misc_feature: HEFZJCU01DYLXS.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagag

SEQ ID NO: 445537 - DNA, 379 bp, Homo sapiens; identical to SEQ ID NO: 444450
  misc_feature: HEFZJCU01CNWWA.47.77.G11.1.454.heavy.3.raw

SEQ ID NO: 445538 - DNA, 502 bp, Homo sapiens
  misc_feature: HEFZJCU01CYX9Y.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacgggacacccccacgaacacagtctacatgcaactgacgagcctgagagctgacgacacggccgtctattactgtgcgagaatgttttctgtcatcgtacaatttgataggctctatggactggacttctc

SEQ ID NO: 445539 - DNA, 316 bp, Homo sapiens; identical to SEQ ID NO: 444444
  misc_feature: HEFZJCU01E08XM.47.56.F01.1.454.heavy.3.raw

SEQ ID NO: 445540 - DNA, 409 bp, Homo sapiens
  misc_feature: HEFZJCU01CH1NZ.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaaggaccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 445541 - DNA, 496 bp, Homo sapiens
  misc_feature: HEFZJCU01CDI1C.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttccccctggcaccctcctccaagagcacctctgggggcacagcggccctgggctgcctggtcaaggactacttcctcgtactgcg

SEQ ID NO: 445542 - DNA, 510 bp, Homo sapiens
  misc_feature: HEFZJCU01CYGGP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 445543 - DNA, 487 bp, Homo sapiens
  misc_feature: HEFZJCU01B9OFB.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggcctgggctgcctggtcaaggactactcctacgtgagct

SEQ ID NO: 445544 - DNA, 483 bp, Homo sapiens; identical to SEQ ID NO: 444924
  misc_feature: HEFZJCU01EQ4M1.10.35.D02.1.454.heavy.3.raw

SEQ ID NO: 445545 - DNA, 525 bp, Homo sapiens
  misc_feature: HEFZJCU01EUTCU.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccctgggc

SEQ ID NO: 445546 - DNA, 352 bp, Homo sapiens
  misc_feature: HEFZJCU01EISSW.10.38.D05.1.454.heavy.3.raw
catagtagtgcacgaccggtgctcgatttagtatctgatagttgggtttggggggaagaggaagactgacggtcctgccacaggtggtgctgggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 445547 - DNA, 395 bp, Homo sapiens
  misc_feature: HEFZJCU01AOMY4.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactgggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 445548 - DNA, 502 bp, Homo sapiens
  misc_feature: HEFZJCU01A593B.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctcccgagagcacagcggccctgggctgcctggtcaaggactacttcctatgtatact

SEQ ID NO: 445549 - DNA, 375 bp, Homo sapiens; identical to SEQ ID NO: 445125
  misc_feature: HEFZJCU01DUW4C.9.53.E09.1.454.heavy.3.raw

SEQ ID NO: 445550 - DNA, 384 bp, Homo sapiens; identical to SEQ ID NO: 444454
  misc_feature: HEFZJCU01EF38I.11.61.F06.1.454.heavy.3.raw

SEQ ID NO: 445551 - DNA, 519 bp, Homo sapiens; identical to SEQ ID NO: 445330
  misc_feature: HEFZJCU01EIW5G.7.78.H01.1.454.heavy.3.raw

SEQ ID NO: 445552 - DNA, 465 bp, Homo sapiens; identical to SEQ ID NO: 444805
  misc_feature: HEFZJCU01A7UFI.19.10.A10.1.454.heavy.3.raw

SEQ ID NO: 445553 - DNA, 464 bp, Homo sapiens
  misc_feature: HEFZJCU01CJ5M6.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 445554 - DNA, 437 bp, Homo sapiens; identical to SEQ ID NO: 444603
  misc_feature: HEFZJCU01B6B2M.3.21.B10.1.454.heavy.3.raw

SEQ ID NO: 445555 - DNA, 408 bp, Homo sapiens
  misc_feature: HEFZJCU01DR8L6.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggacacttccgagtgcgtct

SEQ ID NO: 445556 - DNA, 446 bp, Homo sapiens
  misc_feature: HEFZJCU01BBU9C.51.38.D05.1.454.heavy.3.raw
cgatcgtatacacgaccggtgctcgatttagtatctgatagttgggtttgggtagttgggtttggggggaagaggaagactgacggtccccccaggagttcaggtgctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 445557 - DNA, 396 bp, Homo sapiens; identical to SEQ ID NO: 444426
  misc_feature: HEFZJCU01EHLH7.18.31.C09.1.454.heavy.3.raw

SEQ ID NO: 445558 - DNA, 379 bp, Homo sapiens; identical to SEQ ID NO: 444450
  misc_feature: HEFZJCU01EK87M.47.77.G11.1.454.heavy.3.raw

SEQ ID NO: 445559 - DNA, 514 bp, Homo sapiens
  misc_feature: HEFZJCU01E0V3K.51.9.A09.1.454.heavy.3.raw
cgatcgtatacacgaccggtgctcgatttagcgagacgcgcagggcacgaccggtgctcgatttagtatctgatagttgggtttggggggtttggggggaagaggaagactgacggtcctcccaggagttcaggtgctgggcaccgtgggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaacttttgatatctggggccacgggacaatggtcaccgtctcttcagcttccaccaagggcccatcggtcttcccctggcgccctgctccaggagcacctctgggggcacagcggccctgggctgcctggtcaaggactacttcctcgtagcact

SEQ ID NO: 445560 - DNA, 522 bp, Homo sapiens
  misc_feature: HEFZJCU01CMIMQ.48.57.F02.1.454.heavy.3.raw
agtatacatacacgaccggtgctcgatttagctcgatatagttgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcctccaccaaggccatcggtcttcccctggc

SEQ ID NO: 445561 - DNA, 391 bp, Homo sapiens
  misc_feature: HEFZJCU01B8PST.13.77.G11.1.454.heavy.3.raw
tcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaaccctggtcaccgtctcctcaccctccaccaagggcccatcggtcttccccctggcaccctcctccaagagcacctctgggggcacagcggccctgggctgcctggtcaaggactacttcctagtacgtga

SEQ ID NO: 445562 - DNA, 480 bp, Homo sapiens; identical to SEQ ID NO: 445011
  misc_feature: HEFZJCU01BJPS7.22.36.D03.1.454.heavy.3.raw

SEQ ID NO: 445563 - DNA, 502 bp, Homo sapiens
  misc_feature: HEFZJCU01BOSMN.10.38.D05.1.454.heavy.3.raw
catagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactact

SEQ ID NO: 445564 - DNA, 384 bp, Homo sapiens
  misc_feature: HEFZJCU01DPD5S.47.29.C07.1.454.heavy.3.raw
agctcacgtacacgaccggtgctcgatttagagtgctacgaagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctgggctgcctggtcaaggactacttcctacgtgagct

SEQ ID NO: 445565 - DNA, 462 bp, Homo sapiens; identical to SEQ ID NO: 444770
  misc_feature: HEFZJCU01DN6Q5.40.23.C01.1.454.heavy.3.raw

SEQ ID NO: 445566 - DNA, 522 bp, Homo sapiens
  misc_feature: HEFZJCU01CI2QC.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagacgcacagcggccctgggctgcctggtcaaggactacttcctacg

SEQ ID NO: 445567 - DNA, 437 bp, Homo sapiens; identical to SEQ ID NO: 444603
  misc_feature: HEFZJCU01CRDU5.3.21.B10.1.454.heavy.3.raw

SEQ ID NO: 445568 - DNA, 315 bp, Homo sapiens; identical to SEQ ID NO: 444422
  misc_feature: HEFZJCU01DJ1JH.47.84.H07.1.454.heavy.3.raw

SEQ ID NO: 445569 - DNA, 489 bp, Homo sapiens
  misc_feature: HEFZJCU01DK2TK.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgctcctggggccagggaaccctggtcaccgtctcct

SEQ ID NO: 445570 - DNA, 396 bp, Homo sapiens; identical to SEQ ID NO: 444426
  misc_feature: HEFZJCU01CAOTB.18.31.C09.1.454.heavy.3.raw

SEQ ID NO: 445571 - DNA, 517 bp, Homo sapiens
  misc_feature: HEFZJCU01A0TZU.48.38.D05.1.454.heavy.3.raw
agtatacatacacgaccggtgctcgatttagtatctgatagttgggtttggggggaaaaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtata

SEQ ID NO: 445572 - DNA, 535 bp, Homo sapiens
  misc_feature: HEFZJCU01CZKZD.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggaggggcctttcatgtctgggccaagggacgctggtcaccgtctcttcagcctccaccaagggcccatcggtcttcccctggcaccctcctccaagagcacctctgggggcacagcc

SEQ ID NO: 445573 - DNA, 513 bp, Homo sapiens
  misc_feature: HEFZJCU01CVVWY.52.34.D01.1.454.heavy.3.raw
cgcagtacgacacgaccggtgctcgatttagatcgtctgtgcaactgttggagtctgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 445574 - DNA, 490 bp, Homo sapiens
  misc_feature: HEFZJCU01D84NO.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcgacaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 445575 - DNA, 511 bp, Homo sapiens
  misc_feature: HEFZJCU01ECBL1.48.83.H06.1.454.heavy.3.raw
agtatacatacacgaccggtgctcgatttagatcacgtgcgtcgcgggcacgaccggtgctcgatttagagtatacatattgggtttggggtttgggtgctgggcacggtgggcatgtgtgagttttgtcacaagatttgggctcaactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtctggggccaagggatcacggtcaccgtctcctcagcctccaccaagggcccatcggtcttccccctggcaccctcctccaagagcacctctgggg

SEQ ID NO: 445576 - DNA, 380 bp, Homo sapiens
  misc_feature: HEFZJCU01E13PJ.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcgacagcggccctgggctgcctggtcaaggactacttcctacgtgagct

SEQ ID NO: 445577 - DNA, 395 bp, Homo sapiens; identical to SEQ ID NO: 444517
  misc_feature: HEFZJCU01BOLBJ.16.68.G02.1.454.heavy.3.raw

SEQ ID NO: 445578 - DNA, 395 bp, Homo sapiens
  misc_feature: HEFZJCU01DVGNG.14.79.H02.1.454.heavy.3.raw
cgtctagtaccacgaccggtgctcgatttagtgtcacacgaagggaaggggctggagtgggtggccaacatatttcagcatacaaatgagatgttctttgcggactctgtgaggggccgattcaccatctccagagacaacgccaagaactcagtgtatctgcaaatgaacagcctgagagtcgaggacacggctgtctactactgtgcgagagattgtagtagtgacggctgccatacgtctcttgacttctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 445579 - DNA, 399 bp, Homo sapiens; identical to SEQ ID NO: 444863
  misc_feature: HEFZJCU01BLWUZ.4.77.G11.1.454.heavy.3.raw

SEQ ID NO: 445580 - DNA, 411 bp, Homo sapiens
  misc_feature: HEFZJCU01D9KI2.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctcgtagcact

SEQ ID NO: 445581 - DNA, 505 bp, Homo sapiens
  misc_feature: HEFZJCU01C3SQT.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaaggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 445582 - DNA, 518 bp, Homo sapiens
  misc_feature: HEFZJCU01BWIX1.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctcgtgggggcacagcggccctgggctgcctggtcaaggactacttccagacgtatca

SEQ ID NO: 445583 - DNA, 477 bp, Homo sapiens
  misc_feature: HEFZJCU01DVFZX.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctccctcagcctccaccaagggcccatcggtcttccccctggcaccctcctccaagagcacctctggggcacagcggccctgggctgcctggtcaaggactacttccgagtagtaca

SEQ ID NO: 445584 - DNA, 496 bp, Homo sapiens
  misc_feature: HEFZJCU01EKJ8E.16.37.D04.1.454.heavy.3.raw
tgtactactccacgaccggtgctcgatttagtagcatactgtgggtttgggggagacttagtacagccgggggggtccctgagactctcctatgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 445585 - DNA, 396 bp, Homo sapiens; identical to SEQ ID NO: 444469
  misc_feature: HEFZJCU01CTZF2.47.46.E02.1.454.heavy.3.raw

SEQ ID NO: 445586 - DNA, 509 bp, Homo sapiens
  misc_feature: HEFZJCU01B0SMA.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggcaccctcctccaagagcacctctgggggcacagcggccctgggctgcctggtcaggactacttcctacgtcgtat

SEQ ID NO: 445587 - DNA, 528 bp, Homo sapiens
  misc_feature: HEFZJCU01EPTQ6.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccaggggaaccctggtcaccgtctcctcagcctccaccg

SEQ ID NO: 445588 - DNA, 530 bp, Homo sapiens
  misc_feature: HEFZJCU01E0WDF.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatcggtcttccccctggcaccctcctcc

SEQ ID NO: 445589 - DNA, 514 bp, Homo sapiens
  misc_feature: HEFZJCU01CWERX.51.17.B06.1.454.heavy.3.raw
cgatcgtatacacgaccggtgctcgatttagtcgatagtgaaggggcagtgactcctgtgccccaccatggacacactttgctccacgctcctgctgctgaccatcccttcatgggtcttgtcccagatcaccttgaaggagtctggtcctacactggtgaaacccacacagaccctctcgctgacctgcgccttctctgggttctcactcagcagtagtggagtgggtgtgggctggatccgtcagcccccaggaaaggccctggagtgggttgcactcatttattggaatgatgaaagccgctacagcccatctctgaagagcaggctcaccatctcgaggggcaggtccgaaaaccaggtgatccttacgatgagtaacttggaccctgtggacacagccacatattactgtgcacacaggttcggcgatttttggagtggttattcaaacccctacttcgacttctggggcccgggaatccgtggtcaccgtctcctcagcctcaccaac

SEQ ID NO: 445590 - DNA, 491 bp, Homo sapiens; identical to SEQ ID NO: 444592
  misc_feature: HEFZJCU01CPIFS.11.26.C04.1.454.heavy.3.raw

SEQ ID NO: 445591 - DNA, 521 bp, Homo sapiens
  misc_feature: HEFZJCU01BE389.12.40.D07.1.454.heavy.3.raw
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctcaccaagggcccatcggtcttcccctggcg

SEQ ID NO: 445592 - DNA, 379 bp, Homo sapiens; identical to SEQ ID NO: 444450
  misc_feature: HEFZJCU01EC4IQ.47.77.G11.1.454.heavy.3.raw

SEQ ID NO: 445593 - DNA, 430 bp, Homo sapiens; identical to SEQ ID NO: 444675
  misc_feature: HEFZJCU01BLVA1.40.34.D01.1.454.heavy.3.raw

SEQ ID NO: 445594 - DNA, 508 bp, Homo sapiens
  misc_feature: HEFZJCU01ERUET.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggacg

SEQ ID NO: 445595 - DNA, 508 bp, Homo sapiens
  misc_feature: HEFZJCU01DT1PJ.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagcgtggatttcctttaggctatttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgattttt

SEQ ID NO: 445596 - DNA, 327 bp, Homo sapiens; identical to SEQ ID NO: 444439
  misc_feature: HEFZJCU01EI6W1.40.20.B09.1.454.heavy.3.raw

SEQ ID NO: 445597 - DNA, 422 bp, Homo sapiens
  misc_feature: HEFZJCU01CZOWB.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagtaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggctacttccgagtagtaca

SEQ ID NO: 445598 - DNA, 445 bp, Homo sapiens
  misc_feature: HEFZJCU01D1UGJ.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggccagggaaccctggtcagcgtctcctcagcctccaccaagggcccatcggtcttccccctggcgccctgctccaggagcacctccgagagcacagcggccctggcctgcctggtcaaggactacttcctacgtgagct

SEQ ID NO: 445599 - DNA, 518 bp, Homo sapiens; identical to SEQ ID NO: 444718
  misc_feature: HEFZJCU01A1LG7.9.34.D01.1.454.heavy.3.raw

SEQ ID NO: 445600 - DNA, 477 bp, Homo sapiens; identical to SEQ ID NO: 444659
  misc_feature: HEFZJCU01B4031.16.10.A10.1.454.heavy.3.raw

SEQ ID NO: 445601 - DNA, 509 bp, Homo sapiens
  misc_feature: HEFZJCU01BG29Q.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgatgacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 445602 - DNA, 309 bp, Homo sapiens; identical to SEQ ID NO: 444418
  misc_feature: HEFZJCU01DZ1U7.18.53.E09.1.454.heavy.3.raw

SEQ ID NO: 445603 - DNA, 519 bp, Homo sapiens; identical to SEQ ID NO: 444867
  misc_feature: HEFZJCU01EICVC.9.34.D01.1.454.heavy.3.raw

SEQ ID NO: 445604 - DNA, 403 bp, Homo sapiens; identical to SEQ ID NO: 444540
  misc_feature: HEFZJCU01B8G3H.16.72.G06.1.454.heavy.3.raw

SEQ ID NO: 445605 - DNA, 395 bp, Homo sapiens; identical to SEQ ID NO: 444517
  misc_feature: HEFZJCU01AW7YO.16.68.G02.1.454.heavy.3.raw

SEQ ID NO: 445606 - DNA, 400 bp, Homo sapiens
  misc_feature: HEFZJCU01DG8X6.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctggtctgcctggtcaaggactacttcctacgtgagct

SEQ ID NO: 445607 - DNA, 489 bp, Homo sapiens; identical to SEQ ID NO: 444791
  misc_feature: HEFZJCU01BLMWO.47.85.H08.1.454.heavy.3.raw

SEQ ID NO: 445608 - DNA, 533 bp, Homo sapiens
  misc_feature: HEFZJCU01D4EJ6.48.43.D10.1.454.heavy.3.raw
agtatacatacacgaccggtgctcgatttagactagcagtaagggggtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgcctggggccgagggaaaactggtcaccgtctcctcagcttccaccaaggcccatcggtcttcccctggcgccct

SEQ ID NO: 445609 - DNA, 480 bp, Homo sapiens; identical to SEQ ID NO: 445011
  misc_feature: HEFZJCU01EXDW3.22.36.D03.1.454.heavy.3.raw

SEQ ID NO: 445610 - DNA, 507 bp, Homo sapiens
  misc_feature: HEFZJCU01DH1JS.52.37.D04.1.454.heavy.3.raw
cgcagtacgacacgaccggtgctcgatttagtagcatactgttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttccta

SEQ ID NO: 445611 - DNA, 495 bp, Homo sapiens
  misc_feature: HEFZJCU01A38KW.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttcccctggcaccctcctccaagagcacctctgggggcacagcggccctgggctgcctggtcaaggactacttcctcgtactgcg

SEQ ID NO: 445612 - DNA, 483 bp, Homo sapiens; identical to SEQ ID NO: 444639
  misc_feature: HEFZJCU01EI943.11.23.C01.1.454.heavy.3.raw

SEQ ID NO: 445613 - DNA, 496 bp, Homo sapiens
  misc_feature: HEFZJCU01EBH6N.13.10.A10.1.454.heavy.3.raw
tcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattggggcggaaggtatagca

SEQ ID NO: 445614 - DNA, 379 bp, Homo sapiens; identical to SEQ ID NO: 444549
  misc_feature: HEFZJCU01CRFCG.47.77.G11.1.454.heavy.3.raw

SEQ ID NO: 445615 - DNA, 506 bp, Homo sapiens; identical to SEQ ID NO: 444696
  misc_feature: HEFZJCU01C4BX8.16.34.D01.1.454.heavy.3.raw

SEQ ID NO: 445616 - DNA, 517 bp, Homo sapiens
  misc_feature: HEFZJCU01BW1HN.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 445617 - DNA, 519 bp, Homo sapiens
  misc_feature: HEFZJCU01BZ7FJ.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 445618 - DNA, 381 bp, Homo sapiens; identical to SEQ ID NO: 445431
  misc_feature: HEFZJCU01BH8PD.3.70.G04.1.454.heavy.3.raw

SEQ ID NO: 445619 - DNA, 483 bp, Homo sapiens; identical to SEQ ID NO: 444924
  misc_feature: HEFZJCU01ERQ9H.10.35.D02.1.454.heavy.3.raw

SEQ ID NO: 445620 - DNA, 489 bp, Homo sapiens
  misc_feature: HEFZJCU01EGBVE.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggcgccctgctccaggagcacctccgagagcacagcggcccgtgggctgcctggtcaaggactacttcctacgtgagct

SEQ ID NO: 445621 - DNA, 505 bp, Homo sapiens
  misc_feature: HEFZJCU01B2326.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaaggcccatcggtcttcccctggcgccctgctccaggagcacctccgagagcacagcggccctgggctgcctggtcaaggactacttcctatgtatact

SEQ ID NO: 445622 - DNA, 400 bp, Homo sapiens; identical to SEQ ID NO: 444452
  misc_feature: HEFZJCU01BLZBF.47.24.C02.1.454.heavy.3.raw

SEQ ID NO: 445623 - DNA, 491 bp, Homo sapiens; identical to SEQ ID NO: 444592
  misc_feature: HEFZJCU01B3M5G.11.26.C04.1.454.heavy.3.raw

SEQ ID NO: 445624 - DNA, 396 bp, Homo sapiens
  misc_feature: HEFZJCU01AV347.3.12.B01.1.454.heavy.3.raw
agacgcactccacgaccggtgctcgatttagtagtgtagattccgcgggttgtagtcggtgctcccaccatagtgggagcaccgactacaacccgtccctcaagagtcgagtcaccatatcagtagacacgtccaagaatcagatctccctgaacgtgacctctgtgacggccgcagacacggccgtctattactgtgccagttcgtcacatatgcttacgtctgggggagatatcgttttctctgacaactggggccagggttccctggtcaccgtctcctcagcctccaccaagggcccatcggtcttccccctggcaccctcctccaagagcacctctgggggcacgagcggcccgtgggctgcctggtcaaggactacttccgagtgcgtct

SEQ ID NO: 445625 - DNA, 399 bp, Homo sapiens
  misc_feature: HEFZJCU01AZ7E9.53.42.D09.1.454.heavy.3.raw
cgcgtatacacacgaccggtgctcgatttagacacatacgcagggaaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctggggccaggggaccactgtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 445626 - DNA, 525 bp, Homo sapiens
  misc_feature: HEFZJCU01BB1GO.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttccccctggcgccctgctccaggagcacctccgagagcacagcggccctgggctgcctggtcaaggactacttcccgtgtctgat

SEQ ID NO: 445627 - DNA, 523 bp, Homo sapiens
  misc_feature: HEFZJCU01CHG89.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcaggggagttcgactactggggccaggggaaccctggtcaccgtctcctcagcctccaccaaggg

SEQ ID NO: 445628 - DNA, 477 bp, Homo sapiens
  misc_feature: HEFZJCU01BP64U.16.10.A10.1.454.heavy.3.raw
tgtactactccacgaccggtgctcgatttagcgtcgatctcaggggtccctgagactctcctgtgcagcctctggattcacccttagcggttatgccatgagctgggcccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 445629 - DNA, 482 bp, Homo sapiens; identical to SEQ ID NO: 444503
  misc_feature: HEFZJCU01BOSUJ.7.10.A10.1.454.heavy.3.raw

SEQ ID NO: 445630 - DNA, 316 bp, Homo sapiens; identical to SEQ ID NO: 444444
  misc_feature: HEFZJCU01C2016.47.56.F01.1.454.heavy.3.raw

SEQ ID NO: 445631 - DNA, 512 bp, Homo sapiens
  misc_feature: HEFZJCU01DN2MC.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccgagggaaggggctggaatgggtctcaggtattactggtggtggttataccacatactacgcagactccgtgaagggccggttcaccatctccagagacaattccaagaacacactgtatctgcaaatgaacagcctgagagccgaacgacacggccatataattactgtgcgaaagcaccggcagttgcacccatactactttgaactctggggccg

SEQ ID NO: 445632 - DNA, 407 bp, Homo sapiens
  misc_feature: HEFZJCU01B6H5S.11.67.G01.1.454.heavy.3.raw
cgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 445633 - DNA, 534 bp, Homo sapiens
  misc_feature: HEFZJCU01DPQQK.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggcaccctcctcccaagagcacctctc

SEQ ID NO: 445634 - DNA, 369 bp, Homo sapiens
  misc_feature: HEFZJCU01CPZUW.3.42.D09.1.454.heavy.3.raw
agacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaactgaactctatgaccgccgcagacacggctgtttattattgtacgggccgtgtaacgttggactactggggccagggaaccgtggtcaccgtctcctcagccttcaccaagggcccatcggtcttccccctggcaccctcctccaagagcacctctgggggcacagcggccctgggctgcctggtcaaggacacttccgagtgcgtct

SEQ ID NO: 445635 - DNA, 373 bp, Homo sapiens; identical to SEQ ID NO: 445532
  misc_feature: HEFZJCU01B02RJ.7.37.D04.1.454.heavy.3.raw

SEQ ID NO: 445636 - DNA, 372 bp, Homo sapiens
  misc_feature: HEFZJCU01EM1TQ.13.42.D09.1.454.heavy.3.raw
tcacgtactacacgaccggtgctcgatttagacacatacgcagggaaagggactggagtggattgcatacatgagtggaggtggagccaccagatactacgcagagtctgtgaaggaccgtttcatcatttccagagacaacgccaagaactctctgttcctacaaatgaatcgcctgagccccgaggacacggctgtctactactgcgggagacgaggctttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 445637 - DNA, 410 bp, Homo sapiens; identical to SEQ ID NO: 445199
  misc_feature: HEFZJCU01B85R5.9.11.A11.1.454.heavy.3.raw

SEQ ID NO: 445638 - DNA, 505 bp, Homo sapiens
  misc_feature: HEFZJCU01DLX83.11.40.D07.1.454.heavy.3.raw
cgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccgccaggctccaggcaagggactggagtggctatcatttatgtcatttgatggaactaatatatactattctggggccgttaagggtcgattcaccatctccagagacaattccaggaacacgctgtatctgcaattacacagcccgacaactgacgacacggctgtttattactgtgccacagatatacgcgaatttagcaggggtggccagtacagtcatacatttgccaactggggccagggaaccctggtcatcgtctcctcagcctccaccg

SEQ ID NO: 445639 - DNA, 510 bp, Homo sapiens
  misc_feature: HEFZJCU01DSMJR.4.39.D06.1.454.heavy.3.raw
agcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaaggcccatcggtcttcccctggcgccctgctccaggagcacctccgagagcacagcggcctgggctgcctggtcaaggacta

SEQ ID NO: 445640 - DNA, 422 bp, Homo sapiens
  misc_feature: HEFZJCU01C4WYG.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgaccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 445641 - DNA, 544 bp, Homo sapiens
  misc_feature: HEFZJCU01EDC35.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccaggggacaa

SEQ ID NO: 445642 - DNA, 593 bp, Homo sapiens
  misc_feature: HEFZJCU01DN876.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttccccctggcgccctcgcctaccgaggacgacctacctccggggacgacgacgaccggaccgtcggggcccttgggcccttgggtccctacggggtacctaacggttacccttacgttcccgtaggtccggtacgtcggtacgtcgggacgtcgggccg

SEQ ID NO: 445643 - DNA, 399 bp, Homo sapiens
  misc_feature: HEFZJCU01BI0AP.47.24.C02.1.454.heavy.3.raw
agctcacgtacacgaccggtgctcgatttagtacagatcgttagggaaagggactggagtggattggctatgttcattccagtgggagcaccgactataacctctccctcaaggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 445644 - DNA, 435 bp, Homo sapiens
  misc_feature: HEFZJCU01CQ28E.48.82.H05.1.454.heavy.3.raw
agtatacatacacgaccggtgctcgatttagtcgagctctctcgcgggcacgaccggtgctcgatttagtacagatcgttagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 445645 - DNA, 372 bp, Homo sapiens; identical to SEQ ID NO: 444513
  misc_feature: HEFZJCU01ETKGV.5.23.C01.1.454.heavy.3.raw

SEQ ID NO: 445646 - DNA, 419 bp, Homo sapiens
  misc_feature: HEFZJCU01A3ZF0.11.37.D04.1.454.heavy.3.raw
cgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggccaaatattattgtgtcagagacaagactcaattttgtgttcgtggtcactgctggttcgacccctggggccagggaaccctgatcaccgtctcctctgcctccaccaagggcccatcggtcttccccctggcaccctcctccaagagcacctctgggggcacagcggccctgggctgcctggtcaaggactacttccgtatctctcg

SEQ ID NO: 445647 - DNA, 491 bp, Homo sapiens; identical to SEQ ID NO: 444592
  misc_feature: HEFZJCU01EAP6A.11.26.C04.1.454.heavy.3.raw

SEQ ID NO: 445648 - DNA, 504 bp, Homo sapiens
  misc_feature: HEFZJCU01EHHGG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgtc

SEQ ID NO: 445649 - DNA, 488 bp, Homo sapiens
  misc_feature: HEFZJCU01D0DA8.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtgctacaatcac

SEQ ID NO: 445650 - DNA, 374 bp, Homo sapiens; identical to SEQ ID NO: 444502
  misc_feature: HEFZJCU01BQGUS.9.14.B03.1.454.heavy.3.raw

SEQ ID NO: 445651 - DNA, 379 bp, Homo sapiens; identical to SEQ ID NO: 444450
  misc_feature: HEFZJCU01C74P9.47.77.G11.1.454.heavy.3.raw

SEQ ID NO: 445652 - DNA, 324 bp, Homo sapiens; identical to SEQ ID NO: 444475
  misc_feature: HEFZJCU01DVNL3.18.17.B06.1.454.heavy.3.raw

SEQ ID NO: 445653 - DNA, 520 bp, Homo sapiens; identical to SEQ ID NO: 444787
  misc_feature: HEFZJCU01EOLQB.12.71.G05.1.454.heavy.3.raw

SEQ ID NO: 445654 - DNA, 516 bp, Homo sapiens
  misc_feature: HEFZJCU01BMPSB.51.77.G11.1.454.heavy.3.raw
cgatcgtatacacgaccggtgctcgatttagctagtcactcaagggaaaggggcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttcccctggcaccctcctccaagagcacctctgggggcacagcggccctgggctgcctggtcaaggacta

SEQ ID NO: 445655 - DNA, 409 bp, Homo sapiens
  misc_feature: HEFZJCU01EC0E0.49.72.G06.1.454.heavy.3.raw
agtcgagagacacgaccggtgctcgatttagctacgactgcaagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 445656 - DNA, 371 bp, Homo sapiens; identical to SEQ ID NO: 444919
  misc_feature: HEFZJCU01EWDGN.3.1.A01.1.454.heavy.3.raw

SEQ ID NO: 445657 - DNA, 398 bp, Homo sapiens
  misc_feature: HEFZJCU01A7KLH.4.79.H02.1.454.heavy.3.raw
agcactgtagcacgaccggtgctcgatttagtgtcacacgaagggaaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttcccctggcgccctgctccaggagcacctccgagagcacagcggccctgggctgcctggtcaaggactacttccctacagtgct

SEQ ID NO: 445658 - DNA, 516 bp, Homo sapiens
  misc_feature: HEFZJCU01D1HXQ.18.59.F04.1.454.heavy.3.raw
tacgagtatgcacgaccggtgctcgatttagtacacacacttagggattggggagcgtctgggagaggacgccccagccttgggattccccaagtgtttttcattcagtgatcaggactgaacacagaggactcaccatggagtttgggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgaccggggctcctcaatggctttcattactc

SEQ ID NO: 445659 - DNA, 410 bp, Homo sapiens
  misc_feature: HEFZJCU01E13Q4.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcgacagcggccctgggctgcctggtcaaggactacttccgagtgcgtct

SEQ ID NO: 445660 - DNA, 506 bp, Homo sapiens
  misc_feature: HEFZJCU01EBH8U.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaagggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctataggggatttgattccg

SEQ ID NO: 445661 - DNA, 402 bp, Homo sapiens; identical to SEQ ID NO: 444584
  misc_feature: HEFZJCU01EH59Z.10.77.G11.1.454.heavy.3.raw

SEQ ID NO: 445662 - DNA, 475 bp, Homo sapiens
  misc_feature: HEFZJCU01D2WN3.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctcggcgccctgctccaggagcacctccgagagcacagcggccctgggctgcctggtcaaggactacttccgatgcgtct

SEQ ID NO: 445663 - DNA, 495 bp, Homo sapiens
  misc_feature: HEFZJCU01D3O0D.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctggctgcctggtcaaggactac

SEQ ID NO: 445664 - DNA, 505 bp, Homo sapiens
  misc_feature: HEFZJCU01EKM7M.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 445665 - DNA, 470 bp, Homo sapiens; identical to SEQ ID NO: 444866
  misc_feature: HEFZJCU01A0TIC.4.36.D03.1.454.heavy.3.raw

SEQ ID NO: 445666 - DNA, 379 bp, Homo sapiens; identical to SEQ ID NO: 444450
  misc_feature: HEFZJCU01CMXN1.47.77.G11.1.454.heavy.3.raw

SEQ ID NO: 445667 - DNA, 494 bp, Homo sapiens
  misc_feature: HEFZJCU01DUDQG.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggcgtggcaccctgctgactgtctcctcagcctccaccaagggcccatcggtcttcccctggcgccctgctccaggagcacctccgagagcacagcggccctgggctgcctggtcaaggactac

SEQ ID NO: 445668 - DNA, 387 bp, Homo sapiens; identical to SEQ ID NO: 445235
  misc_feature: HEFZJCU01AE4BV.9.63.F08.1.454.heavy.3.raw

SEQ ID NO: 445669 - DNA, 409 bp, Homo sapiens; identical to SEQ ID NO: 444519
  misc_feature: HEFZJCU01AL5V8.3.41.D08.1.454.heavy.3.raw

SEQ ID NO: 445670 - DNA, 427 bp, Homo sapiens; identical to SEQ ID NO: 444708
  misc_feature: HEFZJCU01C4OOU.9.34.D01.1.454.heavy.3.raw

SEQ ID NO: 445671 - DNA, 502 bp, Homo sapiens; identical to SEQ ID NO: 444768
  misc_feature: HEFZJCU01DF5SG.21.70.G04.1.454.heavy.3.raw

SEQ ID NO: 445672 - DNA, 512 bp, Homo sapiens
  misc_feature: HEFZJCU01EZZ3V.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaacaggtggtccttaaaatgaccaacatggacccaactaggcaaaaagcgcgacatattactgtgcacacattgattgtggtcccaccaggtgtcccggggcccgtttcgtatatctggggccgggggacgattcgtcaccgtctctgcagcctccaccaa

SEQ ID NO: 445673 - DNA, 385 bp, Homo sapiens
  misc_feature: HEFZJCU01CA05G.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttaacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 445674 - DNA, 324 bp, Homo sapiens; identical to SEQ ID NO: 444475
  misc_feature: HEFZJCU01BUX70.18.17.B06.1.454.heavy.3.raw

SEQ ID NO: 445675 - DNA, 517 bp, Homo sapiens
  misc_feature: HEFZJCU01EYDCM.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccgggaaccctggtcgccgtctcctcagcctccaccaagggcccatcggtcttcccctggcaccctcctccaagagcacctctgggggcacagcggccctgggctgcctggtcaaggactacttccgacgtacgtac

SEQ ID NO: 445676 - DNA, 475 bp, Homo sapiens
  misc_feature: HEFZJCU01BMNU1.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttcctccccggacactgcggtggcagggtatgatgcatttgatatctggggccaagggacaatggtcaccgtctcttcagcctccaccaagggcccatcggtcttcccctggcgccctgctccaggagcacctccgagagcacagccggccctcgggctgcctggtcaaggactaccttccctaccagtgct

SEQ ID NO: 445677 - DNA, 492 bp, Homo sapiens; identical to SEQ ID NO: 444827
  misc_feature: HEFZJCU01D82QN.4.28.C06.1.454.heavy.3.raw

SEQ ID NO: 445678 - DNA, 463 bp, Homo sapiens
  misc_feature: HEFZJCU01AVTN0.51.5.A05.1.454.heavy.3.raw
cgatcgtatacacgaccggtgctcgatttagatagatagacaggggaccttcctgccagacaccacctcagcccctcctggaagggacaggagcgcgcaagggtgagtcagaccctcctgccctcgatggcaggtggagaagattcagaaaggtctgagatccccgggacgcagcaccactgtcaatgggggccccagacgcctggaccagggcctgcgtgggaaaggcctctgggcacactcaggggctttttgtgaagggtccgcctactgtgtgactacggtaaatacgttaattcttctactacgatatggacgtctggggccaagggaccacggtcaccgtctcttcagcctccaccaagggcccatcggtcttccccctggcaccctcctccaagagcacctctgggggcacagcggccctgggctgcctggtcaaggactacttcctcgtagcact

SEQ ID NO: 445679 - DNA, 491 bp, Homo sapiens; identical to SEQ ID NO: 445333
  misc_feature: HEFZJCU01B4R43.19.53.E09.1.454.heavy.3.raw

SEQ ID NO: 445680 - DNA, 500 bp, Homo sapiens
  misc_feature: HEFZJCU01AUQ88.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtctcccctggcgcctgctccagagcacctctggggcacagcggcctggctgctggtcaggactactccata

SEQ ID NO: 445681 - DNA, 400 bp, Homo sapiens; identical to SEQ ID NO: 444452
  misc_feature: HEFZJCU01EQ1UY.47.24.C02.1.454.heavy.3.raw

SEQ ID NO: 445682 - DNA, 506 bp, Homo sapiens
  misc_feature: HEFZJCU01ENFW7.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 445683 - DNA, 481 bp, Homo sapiens
  misc_feature: HEFZJCU01D63QS.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagctccaccaagggcccatcggtcttcccctggcgccctgctccaggagcacctccgagagcacagcggccctgggctgcctggtcaaggactacttcctacgtgagct

SEQ ID NO: 445684 - DNA, 517 bp, Homo sapiens
  misc_feature: HEFZJCU01AO1U4.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctgggctgcctggtcaaggactacttccagacgtatca

SEQ ID NO: 445685 - DNA, 374 bp, Homo sapiens; identical to SEQ ID NO: 444502
  misc_feature: HEFZJCU01DZLHF.9.14.B03.1.454.heavy.3.raw

SEQ ID NO: 445686 - DNA, 400 bp, Homo sapiens; identical to SEQ ID NO: 444452
  misc_feature: HEFZJCU01DD72I.47.24.C02.1.454.heavy.3.raw

SEQ ID NO: 445687 - DNA, 379 bp, Homo sapiens; identical to SEQ ID NO: 444450
  misc_feature: HEFZJCU01DP9ZB.47.77.G11.1.454.heavy.3.raw

SEQ ID NO: 445688 - DNA, 512 bp, Homo sapiens
  misc_feature: HEFZJCU01BL9G1.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 445689 - DNA, 534 bp, Homo sapiens
  misc_feature: HEFZJCU01B1EXT.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggagggcctttcatgtctgggccaagggacgctggtcaccgtctcttcagcctccaccaagggcccatcggtcttcccctggcaccctcctccaagagcacctctgggggcacagcc

SEQ ID NO: 445690 - DNA, 499 bp, Homo sapiens
  misc_feature: HEFZJCU01BLG20.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactactccga

SEQ ID NO: 445691 - DNA, 311 bp, Homo sapiens
  misc_feature: HEFZJCU01DJSPW.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctggggcacagcggccctgggctgcctggtcaaggactacttcctagagacacg

SEQ ID NO: 445692 - DNA, 482 bp, Homo sapiens; identical to SEQ ID NO: 444503
  misc_feature: HEFZJCU01DLZKW.7.10.A10.1.454.heavy.3.raw

SEQ ID NO: 445693 - DNA, 378 bp, Homo sapiens; identical to SEQ ID NO: 444463
  misc_feature: HEFZJCU01CU03G.47.77.G11.1.454.heavy.3.raw

SEQ ID NO: 445694 - DNA, 335 bp, Homo sapiens
  misc_feature: HEFZJCU01B3H5M.51.58.F03.1.454.heavy.3.raw
cgatcgtatacacgaccggtgctcgatttagtctgatcgagaagggaaagggccgattcaccatctccagagacaattccaagaatacactatatcttcaaatgaacagtctgagacgtgaagacacggctgtctattactgtgcgactgagatgtcttattacgatgccagtggtttagtaccgttcgacccctggggccagggaaccctggtcaccgtctcctcagcttccaccaaggcccatcggtcttccccctggcgccctgctccaggagcacctctggggcacagcggccctgggctgcctggtcaaggactacttcctcgtagcact

SEQ ID NO: 445695 - DNA, 379 bp, Homo sapiens; identical to SEQ ID NO: 444450
  misc_feature: HEFZJCU01DKZMU.47.77.G11.1.454.heavy.3.raw

SEQ ID NO: 445696 - DNA, 504 bp, Homo sapiens
  misc_feature: HEFZJCU01BE8E5.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaatctggggccagggacg

SEQ ID NO: 445697 - DNA, 537 bp, Homo sapiens
  misc_feature: HEFZJCU01B2BFI.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctgggggcacagcc

SEQ ID NO: 445698 - DNA, 501 bp, Homo sapiens; identical to SEQ ID NO: 445027
  misc_feature: HEFZJCU01CA7UV.26.23.C01.1.454.heavy.3.raw

SEQ ID NO: 445699 - DNA, 517 bp, Homo sapiens
  misc_feature: HEFZJCU01BYQJ6.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactacttcct

SEQ ID NO: 445700 - DNA, 510 bp, Homo sapiens
  misc_feature: HEFZJCU01CEUMX.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggccctgggctgcctggtcaaggactacttccgtacta

SEQ ID NO: 445701 - DNA, 437 bp, Homo sapiens
  misc_feature: HEFZJCU01BEEWR.3.21.B10.1.454.heavy.3.raw
agacgcactccacgaccggtgctcgatttagtgtcgtcgcaagggaccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 445702 - DNA, 483 bp, Homo sapiens; identical to SEQ ID NO: 444924
  misc_feature: HEFZJCU01BB1I0.10.35.D02.1.454.heavy.3.raw

SEQ ID NO: 445703 - DNA, 519 bp, Homo sapiens; identical to SEQ ID NO: 444867
  misc_feature: HEFZJCU01EX0HV.9.34.D01.1.454.heavy.3.raw

SEQ ID NO: 445704 - DNA, 392 bp, Homo sapiens; identical to SEQ ID NO: 444682
  misc_feature: HEFZJCU01DIIIG.16.70.G04.1.454.heavy.3.raw

SEQ ID NO: 445705 - DNA, 517 bp, Homo sapiens
  misc_feature: HEFZJCU01B9CEZ.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggcccatcggtcttccccctggcaccctcctccaagagcacctctggggcacagcggccctgggctgcctggtcaaggactacttcctatacg

SEQ ID NO: 445706 - DNA, 414 bp, Homo sapiens
  misc_feature: HEFZJCU01CXZWW.51.29.C07.1.454.heavy.3.raw
cgatcgtatacacgaccggtgctcgatttagagtgctacgaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 445707 - DNA, 383 bp, Homo sapiens
  misc_feature: HEFZJCU01D6H5Q.22.85.H08.1.454.heavy.3.raw
acatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttccagacgtatca

SEQ ID NO: 445708 - DNA, 523 bp, Homo sapiens
  misc_feature: HEFZJCU01C133I.53.33.C11.1.454.heavy.3.raw
  modified_base (453)..(453): a, c, t, g, unknown or other
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgccctgctccggaggcgcnctcggtgggcacgcggccgtccggtcggtcgcgtcgtcgtacgaacgtaacttacctccgtctcgtcgcg

SEQ ID NO: 445709 - DNA, 316 bp, Homo sapiens; identical to SEQ ID NO: 444444
  misc_feature: HEFZJCU01AGFNO.47.56.F01.1.454.heavy.3.raw

SEQ ID NO: 445710 - DNA, 315 bp, Homo sapiens; identical to SEQ ID NO: 444422
  misc_feature: HEFZJCU01EQ5H2.47.84.H07.1.454.heavy.3.raw

SEQ ID NO: 445711 - DNA, 533 bp, Homo sapiens
  misc_feature: HEFZJCU01AVZEZ.48.57.F02.1.454.heavy.3.raw
agtatacatacacgaccggtgctcgatttagctcgatatagttgggtttgggggactcctgtgccccaccatggacacactttgctccacgctcctgctactgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgttacacacaccatcttgacgactggggatgcttttcatttctggggccaggggaccgtggtcgccgtgtctacagcctccaccaagggcccatcggtcttccccctcggccaccct

SEQ ID NO: 445712 - DNA, 396 bp, Homo sapiens; identical to SEQ ID NO: 444469
  misc_feature: HEFZJCU01B3P0T.47.46.E02.1.454.heavy.3.raw

SEQ ID NO: 445713 - DNA, 394 bp, Homo sapiens; identical to SEQ ID NO: 444701
  misc_feature: HEFZJCU01BD5R2.3.12.B01.1.454.heavy.3.raw

SEQ ID NO: 445714 - DNA, 490 bp, Homo sapiens
  misc_feature: HEFZJCU01DF2WL.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgatccaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 445715 - DNA, 490 bp, Homo sapiens
  misc_feature: HEFZJCU01EE3R9.11.13.B02.1.454.heavy.3.raw
cgagagataccacgaccggtgctcgatttagtctagcgactttgggtctgggggaggcttggcccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 445716 - DNA, 462 bp, Homo sapiens; identical to SEQ ID NO: 444770
  misc_feature: HEFZJCU01AZRVH.40.23.C01.1.454.heavy.3.raw

SEQ ID NO: 445717 - DNA, 403 bp, Homo sapiens; identical to SEQ ID NO: 444540
  misc_feature: HEFZJCU01EFZIL.16.72.G06.1.454.heavy.3.raw

SEQ ID NO: 445718 - DNA, 392 bp, Homo sapiens
  misc_feature: HEFZJCU01EKZZD.40.31.C09.1.454.heavy.3.raw
tctagcgactcacgaccggtgctcgatttagacgtctcatcaaggaaggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggcccgggctgcctggtcaaggactacttccagtcgctaga

SEQ ID NO: 445719 - DNA, 518 bp, Homo sapiens; identical to SEQ ID NO: 444718
  misc_feature: HEFZJCU01DBUNS.9.34.D01.1.454.heavy.3.raw

SEQ ID NO: 445720 - DNA, 500 bp, Homo sapiens
  misc_feature: HEFZJCU01B5DRE.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 445721 - DNA, 522 bp, Homo sapiens
  misc_feature: HEFZJCU01BW40J.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctcgtgggggcacagcggcccgtgggctgcctggtcaaggacttacttcctagagacacg

SEQ ID NO: 445722 - DNA, 436 bp, Homo sapiens; identical to SEQ ID NO: 444686
  misc_feature: HEFZJCU01EORWB.40.27.C05.1.454.heavy.3.raw

SEQ ID NO: 445723 - DNA, 521 bp, Homo sapiens
  misc_feature: HEFZJCU01DERG5.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccgggggaaccctggtcaccgtctcttcagcctccaccaagggcccatcggtcttccccctggcaccctcctccaacgagcacctctgggggcacagcc

SEQ ID NO: 445724 - DNA, 385 bp, Homo sapiens; identical to SEQ ID NO: 444438
  misc_feature: HEFZJCU01BBXAR.18.60.F05.1.454.heavy.3.raw

SEQ ID NO: 445725 - DNA, 382 bp, Homo sapiens
  misc_feature: HEFZJCU01BU02M.3.29.C07.1.454.heavy.3.raw
agacgcactccacgaccggtgctcgatttagagtgctacgaagggaagggcctggagtgggtctcaggtattggattggacaatgataggacaggctatgcggactctgtgaagggccgattcaccgtctccgtggacaaggccaggaggtccatgtttctgcaaatgaacagtctgagagctgacgacacggccctctatttttgtggaaaagacatgacaccggggggtcttgactattggggccagggaatccgggtcaccgtctcctcagcctccaccaagggcccatcggtcttccccctggcgccctgctccaggagcacctccgagagcacagcggccctgggctgcctggtcaaggactacttccgagtcgtct

SEQ ID NO: 445726 - DNA, 385 bp, Homo sapiens; identical to SEQ ID NO: 444438
  misc_feature: HEFZJCU01DBUWV.18.60.F05.1.454.heavy.3.raw

SEQ ID NO: 445727 - DNA, 396 bp, Homo sapiens; identical to SEQ ID NO: 444426
  misc_feature: HEFZJCU01DYRSY.18.31.C09.1.454.heavy.3.raw

SEQ ID NO: 445728 - DNA, 524 bp, Homo sapiens
  misc_feature: HEFZJCU01B2NUS.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggactacttcccgtgtctgat

SEQ ID NO: 445729 - DNA, 482 bp, Homo sapiens; identical to SEQ ID NO: 444503
  misc_feature: HEFZJCU01BL89L.7.10.A10.1.454.heavy.3.raw
